(12) United States Patent
Eberz et al.

(10) Patent No.: US 7,285,653 B1
(45) Date of Patent: Oct. 23, 2007

(54) NUCLEIC ACIDS WHICH CODE FOR THE ENZYME ACTIVITIES OF THE SPINOSYN BIOSYNTHESIS

(75) Inventors: Günther Eberz, Odenthal (DE); Volker Möhrle, Köln (DE); Rita Fröde, Cary, NC (US); Robert Velten, Köln (DE); José A. Salas, Oviedo (ES)

(73) Assignee: Bayer Aktiengesellschaft, Leverkusen (DE)

( * ) Notice: Subject to any disclaimer, the term of this patent is extended or adjusted under 35 U.S.C. 154(b) by 236 days.

(21) Appl. No.: 10/069,353

(22) PCT Filed: Aug. 17, 2000

(86) PCT No.: PCT/EP00/08013

§ 371 (c)(1), (2), (4) Date: Oct. 10, 2002

(87) PCT Pub. No.: WO01/16303

PCT Pub. Date: Mar. 8, 2001

(30) Foreign Application Priority Data

Aug. 27, 1999 (DE) ................................ 199 40 596
Nov. 29, 1999 (DE) ................................ 199 57 268

(51) Int. Cl.
*C07H 21/04* (2006.01)
*C12N 9/00* (2006.01)

(52) U.S. Cl. ............... 536/23.2; 435/320.1; 435/252.3; 435/76; 435/183; 435/189

(58) Field of Classification Search .................. 435/76, 435/320.1, 252.3, 183, 189; 536/23.2
See application file for complete search history.

(56) References Cited

U.S. PATENT DOCUMENTS

| | | | | |
|---|---|---|---|---|
| 5,202,242 | A | 4/1993 | Mynderse et al. | 435/76 |
| 5,227,295 | A | 7/1993 | Baker | 435/76 |
| 5,362,634 | A | 11/1994 | Boeck et al. | 435/76 |
| 5,539,089 | A | 7/1996 | Broughton et al. | 536/6.5 |
| 5,670,364 | A | 9/1997 | Mynderse et al. | 435/252.1 |
| 5,670,486 | A | 9/1997 | Mynderse et al. | 514/28 |
| 5,840,861 | A | 11/1998 | Mynderse et al. | 536/16.8 |
| 6,143,526 | A | 11/2000 | Baltz et al. | 435/76 |
| 6,274,350 | B1 | 8/2001 | Baltz et al. | 435/76 |

FOREIGN PATENT DOCUMENTS

| | | |
|---|---|---|
| EP | 0 837 870 | 7/2002 |
| WO | 99/46387 | 9/1999 |

OTHER PUBLICATIONS

Kirst, H. A. Et Al.,: "Discovery, Isolation, and Structure Elucidation of a Family of Structurally Unique, Fermentation-Derived Tetracyclic Macrolides." 1992, Baker, D. R. , Fenyes, J. G. and Steffens J. J., American Chemical Society Symposium Series Nr. 504: Synthesis and Chemistry of Agrochemicals III. Washington DC XP000944494 Seite 214—Seite 255 das ganze Dokument.

Matsushima P Et Al: "Conjugal Transfer of cosmid DNA from *Escherichia coli* to *Saccharopolyspora spinosa*: effects of chromosomal insertions on macrolide A83543 production" Gene, NL, Elsevier Biomedical Press. Amsterdam, Bd. 146, Nr. 1, 1994, Seiten 39-45, XP002106258, ISSN:0378-1119 das ganze Dokument.

Baltz R H Et Al: "Molecular genetic method for improving secondary-metabolite production in actinomycetes" Trends in Biotechnology, GB, Elsevier Publications, Cambridge, Bd. 14, Nr. 7, Jul. 1, 1996, Seiten 245-250, XP004035763 ISSN: 0167-7799 das ganze Document.

Hopwood D A: "Genetic contributions to understanding polyketid synthases" Chemical Reviews, US, American Chemical Society. Easton, Bd. 97, Nr. 7, Nov. 1997, Seiten 2465-2497, XP002130647 ISSN: 0009-2665 das ganze Dokument.

Pesticide Manual, British Crop Protection Council, 11th ed., (month unavailable) 1997, p. 1272 XDE-105 Insecticide, by Hopwood, Bibb and Chaler.

Gene, 160 (month unavailable) 1995, pp. 25-31, Integrative vectors for heterologous gene expression in *Streptomyces* spp. by Motamedi, A. Shafiee and S. J. Cai.

The Journal of Antibiotics, vol. 51, No. 8, (month unavailable) 1998, pp. 795-800, "Conversion of Spinosyn A and Spinosyn D to Their Respective 9- and 17-Pseudoaglycones and Their Aglycones" by L. C. Creemer, H. A. Kirst and J. W. Paschal.

Gene, 94 (month unavailable) 1990, pp. 53-59, "Construction of a series of pSAM2-based integrative vectors for use in actinomycetes" by T. Smokvina, P. Mazodier, F. Boccard, C. J. Thompson and Michel Guérineau.

Genomics 34, pp. 213-218, (month unavailable) 1996, Article No. 0268, "Construction and Characterization of a Human Bacterial Artificial Chromosome Library" by Ung-Jin Kim et al.

Tetrahedron Letters, vol. 32, No. 37, pp. 4839-4842, (month unavailable) 1991, "A83543A-D, Unique Fermentation-Derived Tetracyclic Macrolides" by H. A. Kirst et al.

Nucleic Acids Research, (month unavailable) 1999, vol. 27, No. 6, "Rapid modification of bacterial artificial chromosomes by ET-recombination" by J. P. P. Muyrers et al.

Gene, 116, (month unavailable) 1992, pp. 43-49, "Plasmid cloning vectors for the conjugal transfer of DNA from *Escherichia coli* to *Streptomyces* spp." by M. Bierman et al.

Proc. Natl. Acad. Sci. USA, vol. 89, pp. 8794-8797, Sep. 1992, "Cloning and stable maintenance of 300-kilobase-pair fragments of human DNA in *Escherichia coli* using an F-factor-based vector" by H. Shizuya et al.

Nucleic Acids Research, vol. 12, No. 1, (month unavailable) 1984, pp. 387-395, "A comprehensive set of sequence analysis programs for the VAX" by J. Devereux et al.

Journal of Bacteriology, Aug. 1983, pp. 459-466, "Amplified DNA in *Streptomyces fradiae*" by S. E. Fishman and C. L. Hershberger.

International Journal of Systematic Bacteriology, Jan. 1990, pp. 34-39, "*Saccharopolyspora spinosa* sp. nov. Isolated from Soil Collected in a Sugar Mill Rum Still" by Frederic P. Mertz and Raymond C. Yao.

(Continued)

*Primary Examiner*—Chih-Min Kam
(74) *Attorney, Agent, or Firm*—Raymond J. Harmuth

(57) ABSTRACT

The present invention relates to nucleic acid coding for enzyme activities of spinosyn biosynthesis and to the relevant enzymes per se. Furthermore, the invention relates to methods for preparing spinsoyn derivatives and spinosyn precursors.

17 Claims, 7 Drawing Sheets

OTHER PUBLICATIONS

Journal of General Microbiology (month unavailable) 1989, 135, 2289-2297, "Protoplast Isolation and Regeneration of *Streptomyces clavuligerus*" by G. T. Illing et al.

Journal of General Microbiology, (month unavailable) 1980, 116, pp. 323-334, *Streptomyces albus* G Mutants Defective in the *Sal*Gl Restriction-Modification System by K. F. Chater and L. C. Wilde.

H. A. Kirst, K. H. Michel, J. S. Myndrase, E. H. Chio, R. C. Yao, W. M. Nakasukasa, L. D. Boeck, J. L. Occlowitz, J. W. Paschal, J. B. Deeter and G. D. Thompson (month unavailable) 1992, Chapter 20, "Discovery, Isolation and Structure Elucidation of a Family of Structurally Unique, Fermentation-Derived Tetracyclic Macrolides". In: D. R. Baker, J. G.,Fenyes and J. J. Steffens (Eds) Synthesis and Chemistry of Agrochemicals III (pp. 214-225) American Chemical Society, Washington, DC (see p. 220 last paragraph in connection with reference No. 33 on p. 225).

Ikeda H et al: "Organization of the biosynthetic gene cluster for the polyketide anthe" Proceedings of the National Academy of Sciences of USA, National Academy of Science, Washington, US, Bd. 96, Nr. 17, Aug. 17, 1999, Seiten 9509-9514, XP002297624.

Schwecke T et al: "The Biosynthetic Gene Cluster for Thepolyketide Immunosuppressant Rapamycin" Proceedings of the National Academy of Sciences of USA, National Academy of Science. Washington, US, Bd. 92, Aug. 1, 1995, Seiten 7839-7843, XP000652288.

Kao C. M. et al: "Engineered Biosynthesis of a Complete Macrolactone in a Heterologous Host" Science, American Association for the Advancement of Science, US, Bd. 265, Nr. 5171, Jul. 22, 1994, Seiten 590-512, XP002073974.

Waldron C et al: "A Cluster of Genes for the Biosynthesis of Spinosyns, Novel Macrolide Insect Control Agents Produced by *Saccharopolyspora spinosa*" Antonie Van Leeuwenhoek, Dordrecht, NL, Bd. 78, Nr. ¾, Dec. 2000, Seiten 385-390, XP008015874.

Waldron C et al: "Cloning and Analysis of the Spinosad Biosynthetic Gene Cluster of *Saccharopolyspora spinosa*" Chemistry and Biology, Current Biology, London, GB, Bd. 8, Nr. 5, May 2001, Seiten 487-499, XP001008017.

Madduri K et al: "Genes of the Biosynthesis of Spinosyns: Applications for Yield Improvement in *Saccharopolyspora spinosa*" Journal of Industrial Microbiology and Biotechnology, Basingstoke, GB, Bd. 27, Nr. 6, Dec. 2001, Seiten 399-402, XP008015876.

Figure 1: Model of the biosynthesis of the spinosyn sugars D-forosamin and 2, 3, 4 tri-O-methyl-L-rhamnose Figure 2: Position of the DNA regions 1 and 2, which are directly or indirectly involved in the biosynthesis of spinosyn as well as position and designation of overlapping cosmid inserts used for sequencing

Figure 4: Illustration of open reading frames of DNA-region 3 (SEQ ID NO. 51) of cosmid 16-2-2

Figure 5: Illustration of open reading frames of the DNA-regions 1 and 2, which are directly or indirectly involved in the biosynthesis of spinosyn

Figure 6: Illustration of open reading frames of the DNA-region 2 and derived polyketide synthase-modules and domains

Modules und domains

SM | M1 | M2 | M3 | M4 | M5 | M6 | M7 | M8 | M9 | M10

Open reading frames

ORF18 | ORF19 | ORF20 | ORF21 | ORF22

Figure 7: Illustration of BAC shuttle clones containing spinosyn biosynthetic genes

DNA-regions

SEQ ID NO. 1, 2 and 3

DNA-region 1 (SEQ ID NO.4)

DNA-region 2 (SEQ ID NO. 5 and 6)

DNA-size scale (kb) and position of ORF's 1 to 22

BAC shuttle clone-designation, as well as size and position of insert-DNA

P11 / G6 ( > 100 kb)

P11 / B10 ( > 100 kb)

P8 / G11 ( > 100 kb)

NUCLEIC ACIDS WHICH CODE FOR THE ENZYME ACTIVITIES OF THE SPINOSYN BIOSYNTHESIS

This application is a 371 of PCT/EP00/08013 filed Aug. 17, 2000.

FIELD OF THE INVENTION

The present invention relates to nucleic acids coding for enzyme activities of spinosyn biosynthesis and to the relevant enzymes per se.

BACKGROUND OF THE INVENTION

Spinosyns represent a novel group of macrolide compounds which have been isolated from the actinomycete *Saccharopolyspora spinosa* (Mertz and Yao, 1990). They are used for controlling insects (WO 97/00265, WO 94/20518, WO 93/09126, U.S. Pat. No. 5,670,364, U.S. Pat. No. 5,362,634, U.S. Pat. No. 5,227,295, U.S. Pat. No. 5,202,242). Spinosyns exhibit a strongly insecticidal but no antibacterial activity, whereby they can be distinguished from conventional macrolides such as tylosin, spiramycin and erythromycin, which have no insecticidal but antimicrobial activity.

The spinosyn structure is composed of a tetracyclic polyketide skeleton (aglycone) with a 12-membered macrolide ring and a 5,6,5-cis-anti-trans-tricycle and also a D-forosamine sugar moiety and a 2,3,4-tri-O-methyl-L-rhamnose sugar moiety (Kirst et al., 1991). More than 20 different natural spinosyn derivatives, the "A83543" complex, have hitherto been described (WO 97/00265, WO 94/20518, WO 93/09126). These derivatives differ in the substitution of one or some methyl groups on the tetracyclic skeleton, on the forosamine sugar moiety or the trimethyl-rhamnose sugar moiety. A 17-pseudoaglycone which lacks the forosamine sugar moiety has likewise been isolated from *S. spinosa* culture broths.

The main components of the A83543 complex formed by *S. spinosa* are the variants spinosyn A and spinosyn D which represent the essential components of the product Spinosad (cf. Pesticide Manual, British Crop Protection Council, 11th Ed., 1997, page 1272 and Dow Elanco trade magazine Down to Earth, Vol. 52, No. 1, 1997, and the references cited therein).

Based on studies on incorporating $^{13}$C-labelled acetate, propionate, butyrate or isobutyrate it was possible to show that the A83543 biosynthesis follows a polyketide biosynthesis path (Nakatsukasa et al., 1990). Polyketides are synthesized from short-chain acid building blocks such as acetate, propionate or butyrate by multifunctional enzymes, the "polyketide synthases" (PKSs). They catalyse, similar to the related fatty acid synthases (FASs), decarboxylating polycondensation steps of the building blocks activated as CoA thioesters. While FASs after each condensation step catalyse, by keto reduction, dehydration and enoyl reduction, a complete reduction of the β-oxoesters which are formed intermediately on the growing polyketide chain, PKSs can dispense with particular reduction steps. Modular type I PKSs consist of one or more large multifunctional proteins. In contrast, iterative type II PKSs are a complex composed of substantially monofunctional proteins.

The enzymatic activities of modular type I PKSs can be combined to "modules". Here, a module carries an arrangement of three enzyme-catalytically active domains which lead to an elongation of the growing polyketide chain by a biosynthetic elongation unit. The said domains are a β-ketoacyl:acyl carrier protein synthase domain, an acyltransferase domain and a β-ketoacyl:acyl carrier protein domain. A module may also carry a ketoreductase domain, a dehydratase domain, an enoylreductase domain and a thioesterase domain. A "loading" module at the start of biosynthesis is able to carry from the said domains only an acyltransferase domain and a β-ketoacyl:acyl carrier protein domain and also an enzymatically inactive β-ketoacyl:acyl carrier protein synthase domain. A polyketide synthase domain comprises one each of the said enzymatic activities.

Owing to the potent insecticidal activity and the remarkable structure of the spinosyns, there is great interest in decoding the genetic information for their biosynthesis.

DETAILED DESCRIPTION OF THE INVENTION

The invention relates to nucleic acids which comprise at least one region coding for an enzyme activity which is involved in biosynthesis of spinosyns.

The present invention provides a cluster of open reading frames (ORFs) whose translation products are involved in biosynthesis of spinosyns. It furthermore provides additional genes or ORFs which are located outside the approx. 120 kb spinosyn biosynthesis cluster and whose translation products are involved in biosynthesis of rhamnose sugars.

The nucleic acids of the invention are in particular single-stranded or double-stranded deoxyribonucleic acids (DNA) or ribonucleic acids (RNA). Embodiments which are preferred are genomic DNA fragments and cDNAs.

The term "at least one region", as used herein, means that the nucleic acid of the invention may comprise one or more sequences which each code for individual activities that carry out steps in the synthesis of spinosyns. Accordingly, nucleic acids which code only for a single enzyme activity in spinosyn biosynthesis are regarded as inventive, too.

The term "enzyme activity", as used herein, means that it is possible to express, starting from the nucleic acids studied herein, at least that part of a complete enzyme, which still exerts the catalytical properties of the enzyme.

The nucleic acids of the invention code in particular for enzyme activities of polyketide synthases, methyl-transferases, epimerases, glycosyltransferases, amino-transferases, dimethyltransferases, reductases, dehydratases and/or cyclization enzymes.

The nucleic acids of the invention are preferably DNA fragments corresponding to *S. spinosa* genomic DNA.

The nucleic acids of the invention particularly preferably comprise at least one sequence selected from
(a) the sequences according to SEQ ID NOS: 1, 2, 3, 4, 5, 7, 9, 11, 13, 15, 17, 19, 21, 23, 25, 27, 29, 31, 33, 35, 37, 39, 41, 43, 45, 47, 49, 51, 52 or 54,
(b) part sequences of at least 14 base pairs in length of the sequences defined under (a),
(c) sequences which hybridize to the sequences defined under (a),
(d) sequences which are at least 70%, preferably 80%, particularly preferably 90%, identical to the sequences defined under (a),
(e) sequences which are complementary to the sequences defined under (a), and
(f) sequences which, due to the degeneracy of the genetic code, code for the same amino acid sequence as the sequences defined under (a) to (d).

The term "hybridize", as used herein, describes the process in which a single-stranded nucleic acid molecule undergoes base pairing with a complementary strand. In this way it is possible, for example starting from genomic DNA from organisms which are phylogenetically related to *S. spinosa* and are capable of spinosyn biosynthesis, to isolate DNA fragments which have the same properties as the fragments isolated from *S. spinosa.*

Preferred hybridization conditions are indicated below: hybridization solution: 5×SSC; blocking reagent (Roche Diagnostics GmbH, Mannheim, Germany), 1%; N-lauroylsarcosine, 0.1%; SDS (sodium dodecyl sulphate) 0.02%; hybridization temperature: 60° C.; first washing step: 2×SSC at 60° C.; second washing step: 2×SSC at 60° C.; preferred second washing step: 0.5×SSC at 60° C.; particularly preferred second washing step: 0.2×SSC at 60° C.

The degree of identity of the nucleic acids is preferably determined with the aid of the GAP program from the GCG program package (Devereux et al., 1984), Version 9.1, under standard conditions.

Particular emphasis is on nucleic acids which comprise (1) either all sequences coding for steps in forosamine and trimethylrhamnose biosyntheses, in particular the sequences according to SEQ ID NOS: 4 and 51, or
(2) all sequences coding for polyketide synthesis steps, in particular the sequences according to SEQ ID NOS: 5 and 6, or
(3) all sequences coding for all steps in forosamine, trimethylrhamnose and polyketide syntheses, in particular the sequences according to SEQ ID NOS: 1, 2, 3 and 51.

All DNA sequences required for spinosyn biosynthesis or for the synthesis of precursors as defined below may therefore be located on a single vector. These nucleic acids, however, may also be present on two or more vectors and be expressed simultaneously or successively in a host cell.

All ORFs of the nucleic acids of the invention may be switched on by their own promoters or by heterologous promoters.

The present invention also relates to the regulatory regions, which control transcription of the nucleic acids of the invention naturally, i.e. in the original organism *S. spinosa.*

The term "regulatory regions", as used herein, relates to promoters, repressor or activator binding sites, repressor or activator sequences, and terminators. This term likewise includes furthermore genetically mobile elements which occur naturally, i.e. in the original organism *S. spinosa*. Such genetically mobile elements may be transposable or mobilizable elements or functional parts thereof, IS elements or other insertion elements. This term furthermore also includes amplifiable DNA elements (amplifiable units of DNA, AUD; Fishman and Hershberger, 1983) which occur naturally, i.e. in the original organism *S. spinosa*. The invention also relates to any combination of these regulatory regions with one another or with heterologous DNA fragments such as, for example, promoters, repressor or activator binding sites, transposable, mobilizable or transducible elements.

The present invention furthermore relates to DNA constructs which comprise at least one nucleic acid of the invention and a heterologous promoter.

The term "heterologous promoter", as used herein, relates to a promoter which does not control expression of the corresponding gene (ORFs) in the original organism.

The selection of heterologous promoters depends on whether prokaryotic or eukaryotic cells or cell-free systems are used for expression. A preferred example of a heterologous promoter is the promoter of the mel gene from the vector pIJ702 (The John Innes Foundation, Norwich, UK 1985). Heterologous expression may be used, for example, in order to achieve an increase in spinosyn production compared with the natural spinosyn producer.

The invention further relates to vectors which contain at least one of the nucleic acids of the invention. Vectors which may be used are all phages, plasmids, phagemids, phasmids, cosmids, YACs, BACs, PACs artificial chromosomes or particles suitable for particle bombardment, which are used in molecular-biological laboratories.

Preference is given to BAC vectors. BAC (bacterial artificial chromosome) vectors have been developed for cloning of large DNA fragments (Shizuya et. al., 1992). They are single-copy plasmids with a factor F origin, which can harbour DNA fragments of an average size of 120 kilo base pairs (kb). They can be replicated in *Escherichia coli*. The BAC vector pBeloBAC11 (Kim et al., 1996) carries a T7 and an SP6 promoter which flank the cloning site and can be used as starting region for sequencing primers and for generating RNA transcripts.

Particular preference is given to the BAC shuttle clones which the present invention relates to and which have been deposited with the Deutsche Sammlung von Mikroorganismen und Zellkulturen GmbH (DSMZ), Mascheroder Weg 1b, D-38124 Brunswick under deposition numbers DSM 13010, DSM 13011 and DSM 13012 in accordance with the requirements of the Budapest Treaty on 18 Aug. 1999.

The deposited BAC shuttle clones P11/G6, P8/G11 and P11/B10 each carry an *S. spinosa* DNA fragment of at least 100 kb in size. The clones P11/G6 and P11/B10 each carry a part of the nucleic acid sequence according to SEQ ID NO: 4 and also the neighbouring complete nucleic acid sequences according to SEQ ID NOS: 5 and 6 and also a DNA region 3' adjacent to the nucleotide sequence according to SEQ ID NO: 6 (FIG. 7). The clone P8/G11 carries a part of the nucleic acid sequence according to SEQ ID NO: 6, the complete nucleic acid sequences according to SEQ ID NOS: 5 and 4 and also a DNA region 3' adjacent to the sequence according to SEQ ID NO: 4 (FIG. 7).

Vectors which are in the same way suitable for spinosyn production are also PAC vectors and all other functionally equivalent vectors which allow transferring large DNA fragments, in particular those DNA fragments larger than 30 kb, preferably larger than 40 kb, particularly preferably larger than 60 kb, into heterologous host cells and ensuring establishing of foreign DNA there. Preference is given to using those BAC, PAC and functionally equivalent vectors which have been modified into a shuttle vector and allow, for example, plasmid replication both in Gram-negative bacteria such as *Escherichia coli* and in Gram-positive bacteria such as *Streptomyces*. Such preferred shuttle vectors may carry DNA fragments of a size which cannot be cloned into conventional vectors such as, for example, cosmid vectors and cannot be transferred into heterologous hosts such as actinomycetes, for example streptomycetes. The latter vectors may be transferred both by transformation, conjugation, electroporation, protoplast transformation or by other suitable methods. It is in an excellent way possible to transfer those shuttle vectors within a heterologous population of Gram-negative or Gram-positive bacteria, between Gram-positive and Gram-negative bacteria, between bacteria and Archea and between prokaryotes and eukaryotes by conjugation. The BAC, PAC or functionally equivalent shuttle vectors, transferred into heterologous hosts such as, for example, streptomycetes, may be replicated autonomously or integrated into the host genome. The latter integration may be carried out via homologous recombination, via a ΦC31 integration mechanism (Hopwood et al., 1985), via location-specific integration which depends on pSAM2 (Smokvina et al., 1990; WO 95/16046)-determined functions or via mini-circle-mediated functions (Motamedi et al., 1995; WO 96/00282).

Such shuttle vectors allow expression of specific biosynthetic pathways of primary or secondary metabolites, which are determined by extraordinarily large DNA regions, by transferring a single recombinant vector heterologously into particularly suitable host cells. Thus it is possible to express the identified cluster for spinosyn biosynthesis in organisms such as actinomycetes, for example *Streptomyces*, by transferring a single recombinant shuttle vector. Owing to the size of this biosynthesis cluster, the said heterologous expression of spinosyn biosynthesis is impossible by using a single cosmid vector. Transferring a recombinant BAC, PAC or functionally equivalent shuttle vector, which carries the nucleic acids of the invention, can result in a significant increase in spinosyn production compared with spinosyn production in the strain *S. spinosa* or in derived mutants with increased spinosyn formation. In addition it is possible to use such a shuttle vector coding for spinosyn biosynthesis for the purpose of utilizing, after transfer into heterologous host cells, their biosynthetic and modifying capabilities, in order to achieve a significant modification of spinosyn or biosynthetic precursors of spinosyn. This makes it in addition possible to produce novel spinosyn derivatives by transferring a single recombinant vector into heterologous host cells.

It is furthermore possible to use such shuttle vectors for genetically modifying cloned biosynthesis pathways of secondary metabolites as part of a single recombinant shuttle vector. Such modifications may be carried out, for example, in an *E. coli* host, for example by utilizing recombination events with participation of the recA gene product or the recE and recT gene products (Muyrers et al., 1999). Furthermore it is possible to modify such vectors by in vitro methods such as, for example, the template generation system (Finnzymes, FIN-02201, Espoo, Finland) or the Transposomics system (Epicentre Technologies, Biozym Diagnostika GmbH, Oldendorf, Germany). Such shuttle vectors coding for modified biosynthetic pathways may then be transferred into suitable host cells in order to produce modified secondary metabolites. Analogously, the said shuttle vectors may be used for modifying the nucleic acids of the invention in order to use them subsequently, after transfer into suitable host cells, for production of modified spinosyns.

Parts of the nucleic acids of the invention may also determine genetic information as components of two or more vectors such as, for example, cosmid vectors which combined with one another are suitable for the biosynthesis of spinosyn or spinosyn precursors such as, for example, pseudoaglycone or spinosyn aglycone. Such combinations of recombinant vectors may be used in order to achieve spinosyn production in organisms other than *S. spinosa*. With expression in particularly suitable hosts, this may result in a significant increase in spinosyn production compared with *S. spinosa* or derived, production-enhanced mutants. It is furthermore possible to modify the nucleic acids of the invention in individual recombinant vectors of the said vector combination such that heterologous production of spinosyn derivatives in host cells is possible. Moreover, such a combination of recombinant vectors may be suited, due to their transfer into heterologous hosts, to forming novel spinosyn derivatives by utilizing the host's endogenous enzyme system.

The present invention also relates to host cells containing at least one of the nucleic acids of the invention. Suitable host cells are both prokaryotic cells, preferably actinomycetes, particularly preferably streptomycetes, and eukaryotic cells such as mammalian cells, plant cells or yeast cells.

In a particular way the nucleic acids of the invention can be transferred into plant cells and be expressed there. This makes it possible to prepare transgenic plants which produce the plant-protecting, insecticidal spinosyn or derivatives thereof. The nucleic acids of the invention may be transferred into the plant cells or plant cell cultures by conventional methods, inter alia also by particle bombardment.

The present invention further relates to the polypeptides encoded by the nucleic acids of the invention. The polypeptides of the invention may constitute a complete enzyme which catalyses a spinosyn biosynthesis step. However, the invention also includes those polypeptides which have only a part of the complete amino acid sequence of the relevant enzyme.

The term "part sequence", as used herein, thus relates to the amino acid sequence of a polypeptide which can still exert the activity of the corresponding complete enzyme or an enzymatically active domain.

In the following, preferred nucleic acids and polypeptides of the invention are characterized in more detail, with reference to the appropriate SEQ ID NOS.

SEQ ID NOS: 7 and 8, ORF1:
Nucleotide position 828 to 1 of SEQ ID NO: 4, 275 amino acids; the derivable gene product is a methyl-transferase.

SEQ ID NOS: 9 and 10, ORF2:
Nucleotide position 1283 to 2455 of SEQ ID NO: 4; 390 amino acids; the derivable gene product is a glycosyl-transferase.

SEQ ID NOS: 11 and 12, ORF3:
Nucleotide position 2495 to 3247 of SEQ ID NO: 4, 250 amino acids; the derivable gene product is a methyl-transferase.

SEQ ID NOS: 13 and 14, ORF4:
Nucleotide position 4440 to 3253 of SEQ ID NO: 4, 395 amino acids; the derivable gene product is a methyl-transferase.

SEQ ID NOS: 15 and 16, ORF5:
Nucleotide position 4578 to 6197 of SEQ ID NO: 4, 539 amino acids; the derivable gene product is a C—C linking enzyme which carries out cyclization reactions.

SEQ ID NOS: 17 and 18, ORF6:
Nucleotide position 6211 to 7404 of SEQ ID NO: 4, 397 amino acids; the derivable gene product is a methyl-transferase.

SEQ ID NOS: 19 and 20, ORF7:
Nucleotide position 7401 to 8300 of SEQ ID NO: 4, 299 amino acids; the derivable gene product is a methyl-transferase.

SEQ ID NOS: 21 and 22, ORF8:
Nucleotide position 8300 to 9466 of SEQ ID NO: 4, 388 amino acids; the derivable gene product is an enzyme which is involved in cyclization reactions.

SEQ ID NOS: 23 and 24, ORF9:
Nucleotide position 10572 to 9562 of SEQ ID NO: 4, 336 amino acids; the derivable gene product is a 2,3-reductase.

SEQ ID NOS: 25 and 26, ORF10:
  Nucleotide position 12029 to 10569 of SEQ ID NO: 4, 486 amino acids; the derivable gene product is a 2,3-dehydratase.

SEQ ID NOS: 27 and 28, ORF11:
  Nucleotide position 12549 to 12109 of SEQ ID NO: 4, 146 amino acids; the derivable gene product has homologies with a thioesterase.

SEQ ID NOS: 29 and 30, ORF12:
  Nucleotide position 13865 to 12546 of SEQ ID NO: 4, 439 amino acids; the derivable gene product is a glycosyltransferase.

SEQ ID NOS: 31 and 32, ORF13:
  Nucleotide position 14245 to 15633 of SEQ ID NO: 4, 462 amino acids; the derivable gene product is a 3,4-dehydratase.

SEQ ID NOS: 33 and 34, ORF14:
  Nucleotide position 15671 to 16828 of SEQ ID NO: 4, 385 amino acids; the derivable gene product is a 4-aminotransferase.

SEQ ID NOS: 35 and 36, ORF15:
  Nucleotide position 16831 to 17580 of SEQ ID NO: 4, 249 amino acids; the derivable gene product is an N-dimethyltransferase.

SEQ ID NOS: 37 and 38, ORF16:
  Nucleotide position 18930 to 18205 of SEQ ID NO: 4, 241 amino acids; the derivable gene product is a 3,4-reductase.

SEQ ID NOS: 39 and 40, ORF17:
  Nucleotide position 19025 to 19861 of SEQ ID NO: 4, 278 amino acids; the derivable gene product is a transcription regulator.

SEQ. ID NOS: 41 and 42, ORF18:

Nucleotide positions 116-7903 of SEQ ID NO: 5, amino acid positions 1 to 2595:
  Nucleotide positions 128-1402, amino acid positions 5-429, encode a β-ketoacyl:acyl carrier protein synthase domain;
  Nucleotide positions 1691-2656, amino acid positions 526-847, encode an acyltransferase domain;
  Nucleotide positions 2798-3052, amino acid positions 895-979, encode a β-ketoacyl:acyl carrier protein domain;
  Nucleotide positions 3107-4372, amino acid positions 998-1419, encode a β-ketoacyl:acyl carrier protein synthase domain;
  Nucleotide positions 4688-5662, amino acid positions 1525-1849, encode an acyltransferase domain;
  Nucleotide positions 6587-7138, amino acid positions 2158-2341, encode a ketoreductase domain;
  Nucleotide positions 7409-7666, amino acid positions 2432-2517, encode a β-ketoacyl:acyl carrier protein domain.

SEQ ID NOS: 43 and 44, ORF19:

Nucleotide positions 7921-14379 of SEQ ID NO: 5, amino acid positions 1 to 2152:
  Nucleotide positions 8029-9318, amino acid positions 37-466, encode a β-ketoacyl:acyl carrier protein synthase domain;
  Nucleotide positions 9634-10608, amino acid positions 572-896, encode an acyltransferase domain;
  Nucleotide positions 10705-11259, amino acid positions 929-1113, encode a dehydratase domain;
  Nucleotide positions 12043-13080, amino acid positions 1375-1720, encode an enoylreductase domain;
  Nucleotide positions 13093-13635, amino acid positions 1725-1905, encode a ketoreductase domain;
  Nucleotide positions 13885-14142, amino acid positions 1989-2074, encode a β-ketoacyl:acyl carrier protein domain;

SEQ ID NOS: 45 and 46, ORF20:

Nucleotide positions 14424-23936 of SEQ ID NO: 5, amino acid positions 1 to 3170:
  Nucleotide positions 14523-15824, amino acid positions 34-467, encode a β-ketoacyl:acyl carrier protein synthase domain;
  Nucleotide positions 16110-17075, amino acid positions 563-884, encode an acyltransferase domain;
  Nucleotide positions 17997-18536, amino acid positions 1192-1371, encode a ketoreductase domain;
  Nucleotide positions 18795-19052, amino acid positions 1458-1543, encode a β-ketoacyl:acyl carrier protein domain;
  Nucleotide positions 19107-20387, amino acid positions 1562-1988, encode a β-ketoacyl:acyl carrier protein synthase domain;
  Nucleotide positions 20718-21692, amino acid positions 2099-2423, encode an acyltransferase domain;
  Nucleotide positions 22620-23171, amino acid positions 2733-2916, encode a ketoreductase domain;
  Nucleotide positions 23436-23693, amino acid positions 3005-3090, encode a β-ketoacyl:acyl carrier protein domain.

SEQ ID NOS: 47 and 48, ORF21:

Nucleotide positions 23983-38757 of SEQ ID NO: 5, amino acid positions 1 to 4924:
  Nucleotide positions 24082-25392, amino acid positions 34-470, encode a β-ketoacyl:acyl carrier protein synthase domain;
  Nucleotide positions 25696-26661, amino acid positions 572-893, encode an acyltransferase domain;
  Nucleotide positions 26761-27315, amino acid positions 927-1111, encode a dehydratase domain;
  Nucleotide positions 28231-28782, amino acid positions 1417-1600, encode a ketoreductase domain;
  Nucleotide positions 29035-29265, amino acid positions 1685-1761, encode a β-ketoacyl:acyl carrier protein domain;
  Nucleotide positions 29329-30624, amino acid positions 1783-2214, encode a β-ketoacyl:acyl carrier protein synthase domain;
  Nucleotide positions 30928-31902, amino acid positions 2316-2640, encode an acyltransferase domain;
  Nucleotide positions 32827-33378, amino acid positions 2949-3132, encode a ketoreductase domain;
  Nucleotide positions 33652-33900, amino acid positions 3224-3306, encode a β-ketoacyl:acyl carrier protein domain;
  Nucleotide positions 33952-35262, amino acid positions 3324-3760, encode a β-ketoacyl:acyl carrier protein synthase domain;
  Nucleotide positions 35554-36522, amino acid positions 3858-4180, encode an acyltransferase domain;
  Nucleotide positions 37453-37998, amino acid positions 4491-4672, encode a ketoreductase domain;
  Nucleotide positions 38254-38.511, amino acid positions 4578-4843, encode a β-ketoacyl:acyl carrier protein domain;

SEQ ID NOS: 49 and 50, ORF22:

Nucleotide positions 38808-50000 of SEQ ID NO: 5 and the nucleotide positions 1 to 5574 of SEQ ID NO: 6, amino acid positions 1 to 5588:

Nucleotide positions 38907-40226 of SEQ ID NO: 5, amino acid positions 34-473, encode a β-ketoacyl:acyl carrier protein synthase domain;

Nucleotide positions 40494-41453 of SEQ ID NO: 5, amino acid positions 563-882, encode an acyltransferase domain;

Nucleotide positions 41556-42119 of SEQ ID NO: 5, amino acid positions 917-1104, encode a dehydratase domain;

Nucleotide positions 43017-43568 of SEQ ID NO: 5, amino acid positions 1404-1587, encode a ketoreductase domain;

Nucleotide positions 43833-44090 of SEQ ID NO: 5, amino acid positions 1676-1761, encode a β-ketoacyl:acyl carrier protein domain;

Nucleotide positions 44151-45473 of SEQ ID NO: 5, amino acid positions 1782-2222, encode a β-ketoacyl:acyl carrier protein synthase domain;

Nucleotide positions 45765-46730 of SEQ ID NO: 5, amino acid positions 2320-2641, encode an acyltransferase domain;

Nucleotide positions 46827-47459 of SEQ ID NO: 5, amino acid positions 2674-2884, encode a dehydratase domain;

Nucleotide positions 48 378-48 935 of SEQ ID NO: 5, amino acid positions 3191-3376, encode a ketoreductase domain;

Nucleotide positions 49182-49412 of SEQ ID NO: 5, amino acid positions 3459-3535, encode a β-ketoacyl:acyl carrier protein domain;

Nucleotide positions 49482-50000 of SEQ ID NO: 5 and nucleotide positions 1 to 759 of SEQ ID NO: 6, amino acid positions 3559-3984, encode a β-ketoacyl:acyl carrier protein synthase domain;

Nucleotide positions 1084-2049 of SEQ ID NO: 6, amino acid positions 4093-4414, encode an acyltransferase domain;

Nucleotide positions 2146-2697 of SEQ ID NO: 6, amino acid positions 4447-4630, encode a dehydratase domain;

Nucleotide positions 3604-4155 of SEQ ID NO: 6, amino acid positions 4933-5116, encode a ketoreductase domain;

Nucleotide positions 4420-4677 of SEQ ID NO: 6, amino acid positions 5205-5290, encode a β-ketoacyl:acyl carrier protein domain;

Nucleotide positions 4864-5538 of SEQ ID NO: 6, amino acid positions 5353-5577, encode a thioesterase domain.

SEQ ID NOS: 52 and 53, ORF23:

Nucleotide position 344 to 1333 of SEQ ID NO: 51, 329 amino acids; the derivable gene product is a dNDP-glucose-4,6-dehydratase.

SEQ ID NOS: 54 and 55, ORF24:

Nucleotide position 1330 to 2247 of SEQ ID NO: 51, 305 amino acids; the derivable gene product is a dNDP-4-keto-6-deoxyglucose-3,5-epimerase.

The products of ORF 5 (SEQ ID NO: 16) and ORF 8 (SEQ ID NO: 22) involved in cyclization of the 5,6,5-tricycle are of particular interest, owing to the unusual cyclization reactions. The present invention therefore includes in particular also homologous nucleic acids or homologous gene products. Advantageously, these homologous gene products show at least 50%, preferably 60% and particularly preferably 70% identity at the amino acid level.

The invention furthermore relates to antibodies binding specifically to the abovementioned polypeptides. Such antibodies are produced in the conventional manner. These antibodies may be used for identifying expression clones of, for example, a gene library, which harbour the nucleic acids of the invention.

The present invention also relates to a method for preparing the nucleic acids of the invention. The nucleic acids of the invention may be prepared in the conventional manner. It is possible, for example, to chemically synthesize the entire nucleic acid molecules. It is also possible to chemically synthesize short sections of the nucleic acids of the invention and to label such oligonucleotides radioactively or with a fluorescent dye. The labelled oligonucleotides may also be used for screening gene libraries of organisms. Clones which hybridize to the labelled oligonucleotides are selected for isolating the relevant DNA. After characterizing the isolated DNA, the nucleic acids of the invention are obtained in a simple manner. The nucleic acids of the invention may also be prepared by means of PCR methods using chemically synthesized oligonucleotides.

The present invention furthermore relates to methods for preparing the polypeptides of the invention. The polypeptides encoded by the nucleic acids of the invention may be prepared by culturing host cells which contain at least one of the nucleic acids of the invention under suitable conditions. The desired polypeptides may subsequently be isolated from the cells or the culture medium in a conventional manner. The polypeptides may also be prepared in in vitro systems.

The isolated and characterized gene cluster and neighbouring or associated DNA regions represent a target for increasing spinosyn biosynthesis by genetic manipulation, over or underexpression of genes or regulatory sequences, which are directly or indirectly involved in the biosynthesis. These manipulations may be carried out both in natural spinosyn-producing organisms and in genetically engineered spinosyn-producing organisms. Thus it is possible, for example, to put selected ORFs under the control of conventional strong promoters such as the mel promoter of plasmid pIJ702 (John Innes Foundation, Norwich, UK, 1985).

By cloning and identifying the genes of spinosyn biosynthesis, the present invention provides the genetic base for preparing novel spinosyn precursors and spinosyn derivatives by means of molecular-genetic methods.

The term "spinosyn precursors", as used herein, relates to all biosynthetic spinosyn precursors which can be detected or postulated.

The term "spinosyn derivatives", as used herein, relates to structural derivatives of all hitherto known spinosyns.

The invention thus also relates to a method for preparing spinosyn precursors and spinosyn derivatives.

Figure 1:
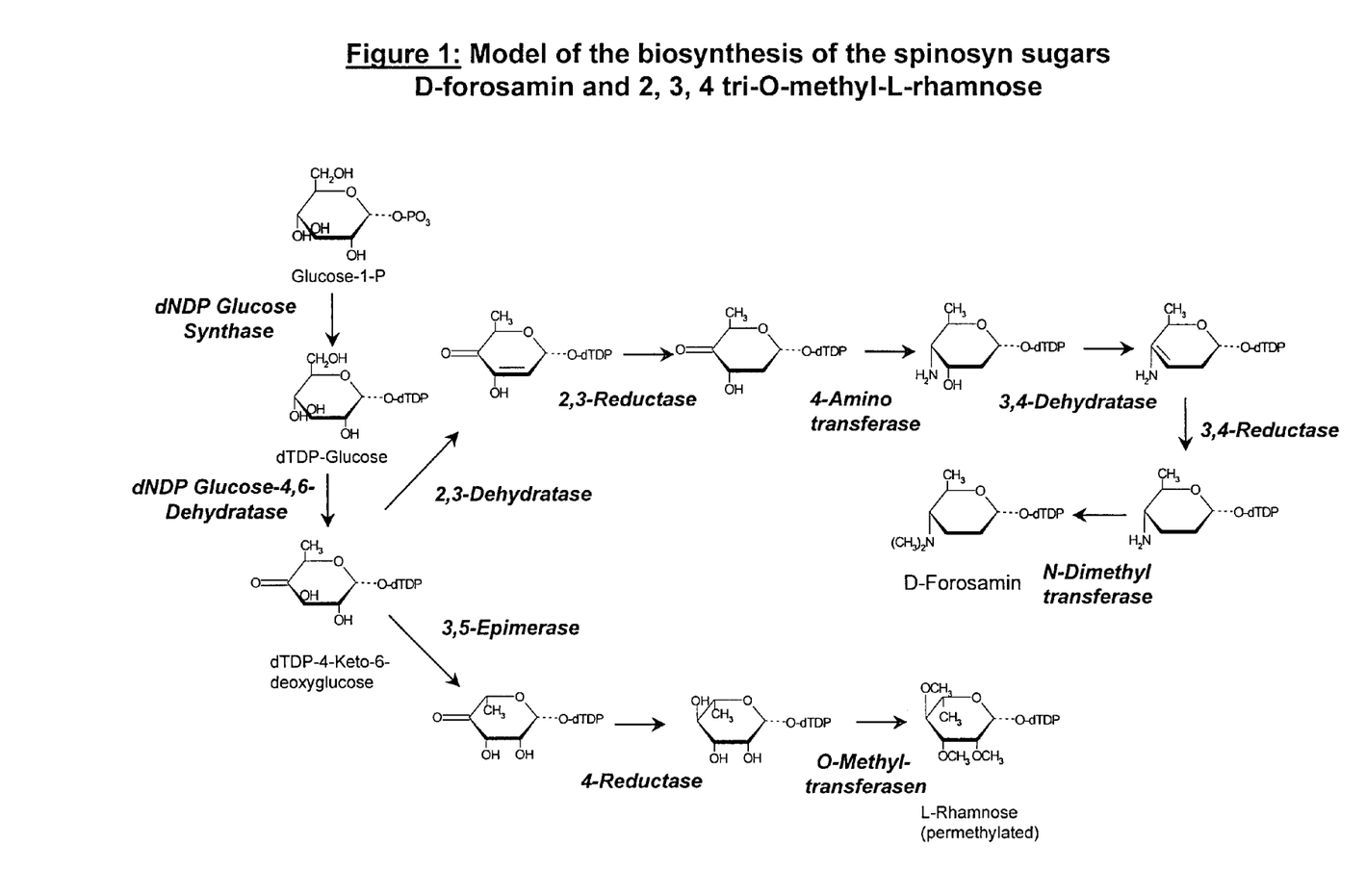
FIG. 1: Model for the biosynthesis of spinosyn sugars D-forosamine and 2,3,4-tri-O-methyl-L-rhamnose.
Figure 2:
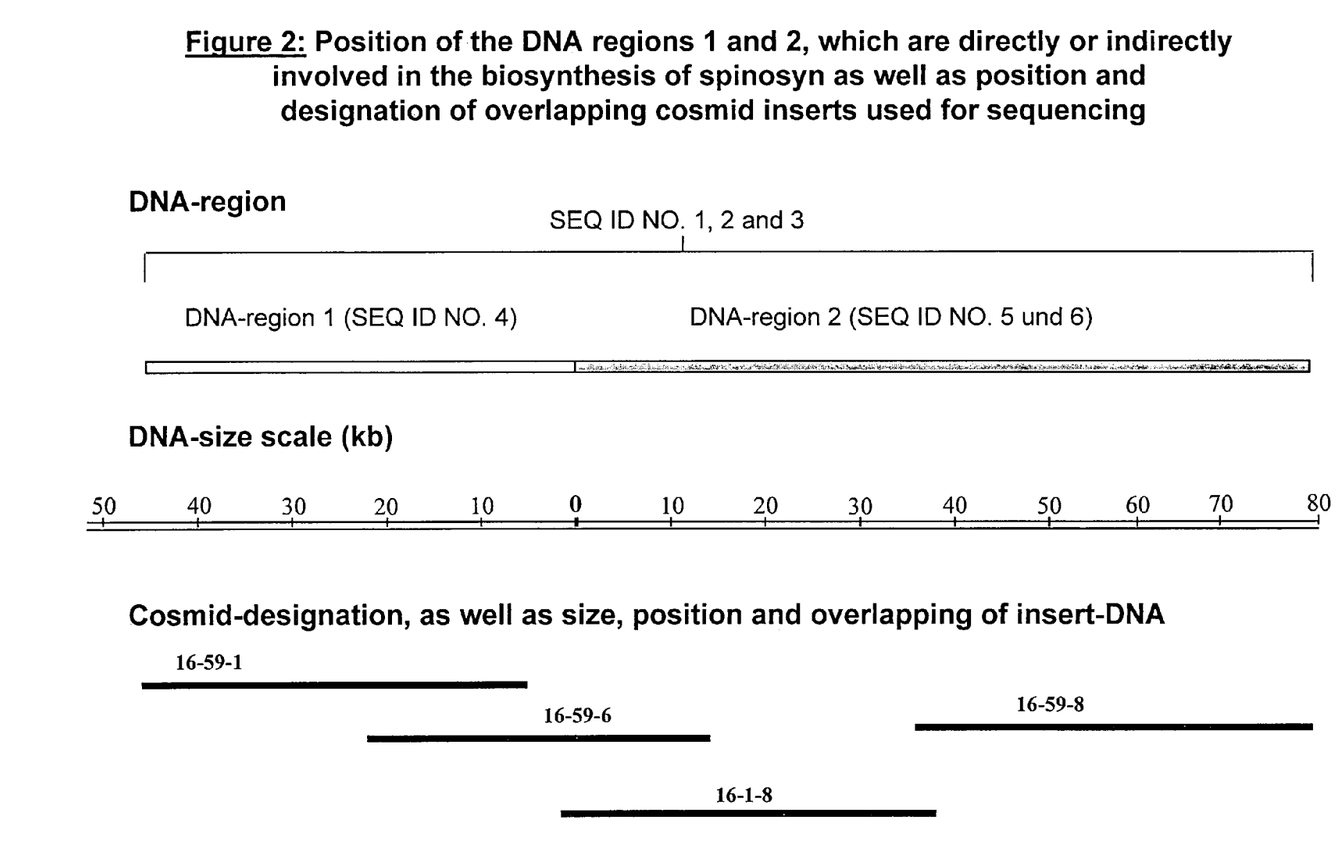
FIG. 2: Location of DNA region 1 (SEQ ID NO: 4) and DNA region 2 (SEQ ID NOS: 5 and 6) which are directly or indirectly involved in spinosyn biosynthesis. The black bars in the bottom part of the figure indicate schematically the positions of the cosmid DNA inserts to one another and in relation to DNA regions 1 and 2. The cosmid inserts shown were used for sequencing SEQ ID NOS: 1 to 3.
Figure 3:
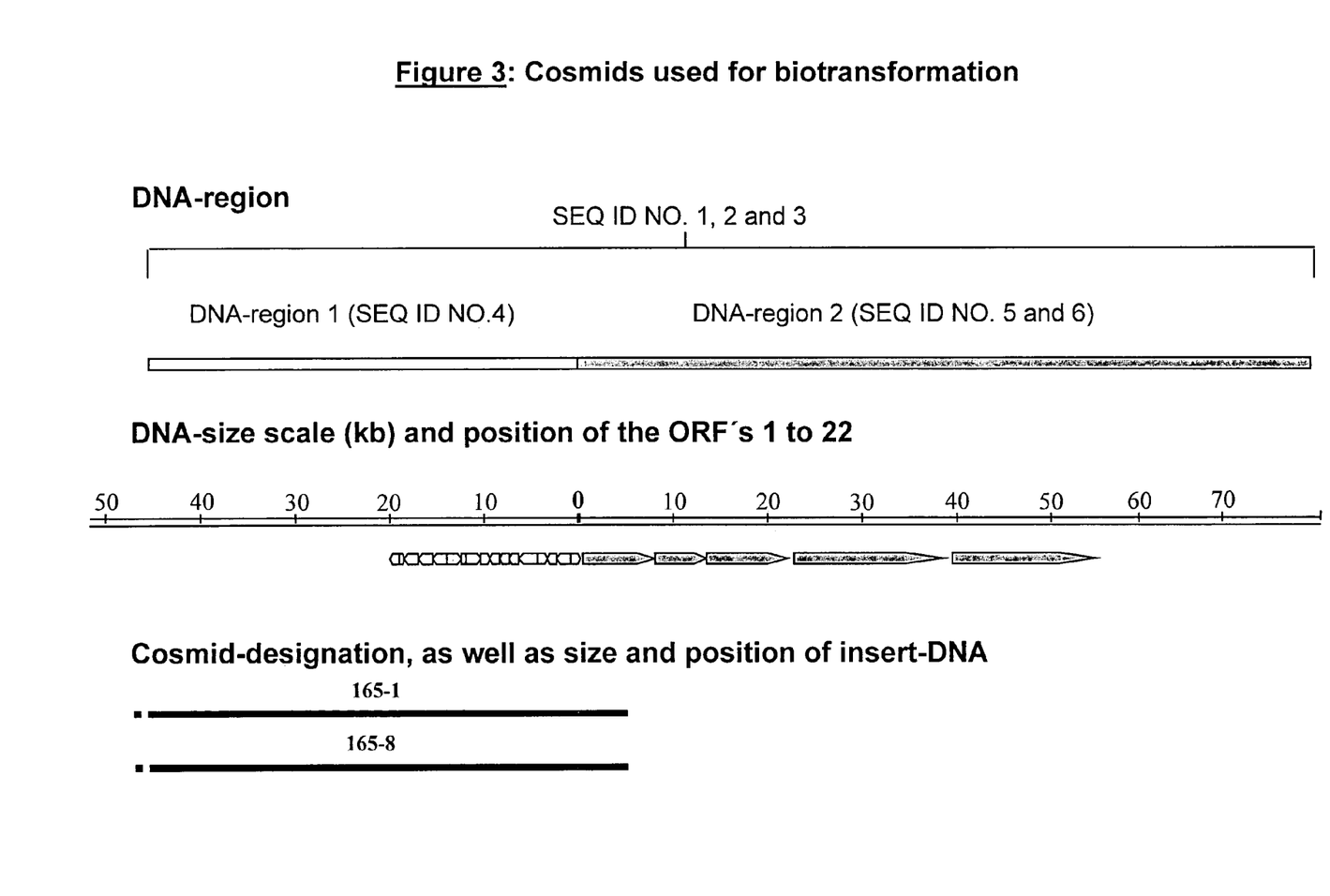
FIG. 3: Schematic representation of the location of the inserted DNA (black bars in the bottom part of the figure) of the said cosmids which have been used for attaching a forosamine residue or a trimethylrhamnose residue by biotransformation of the spinosyn aglycone and spinosyn pseudoaglycone.
Figure 4:
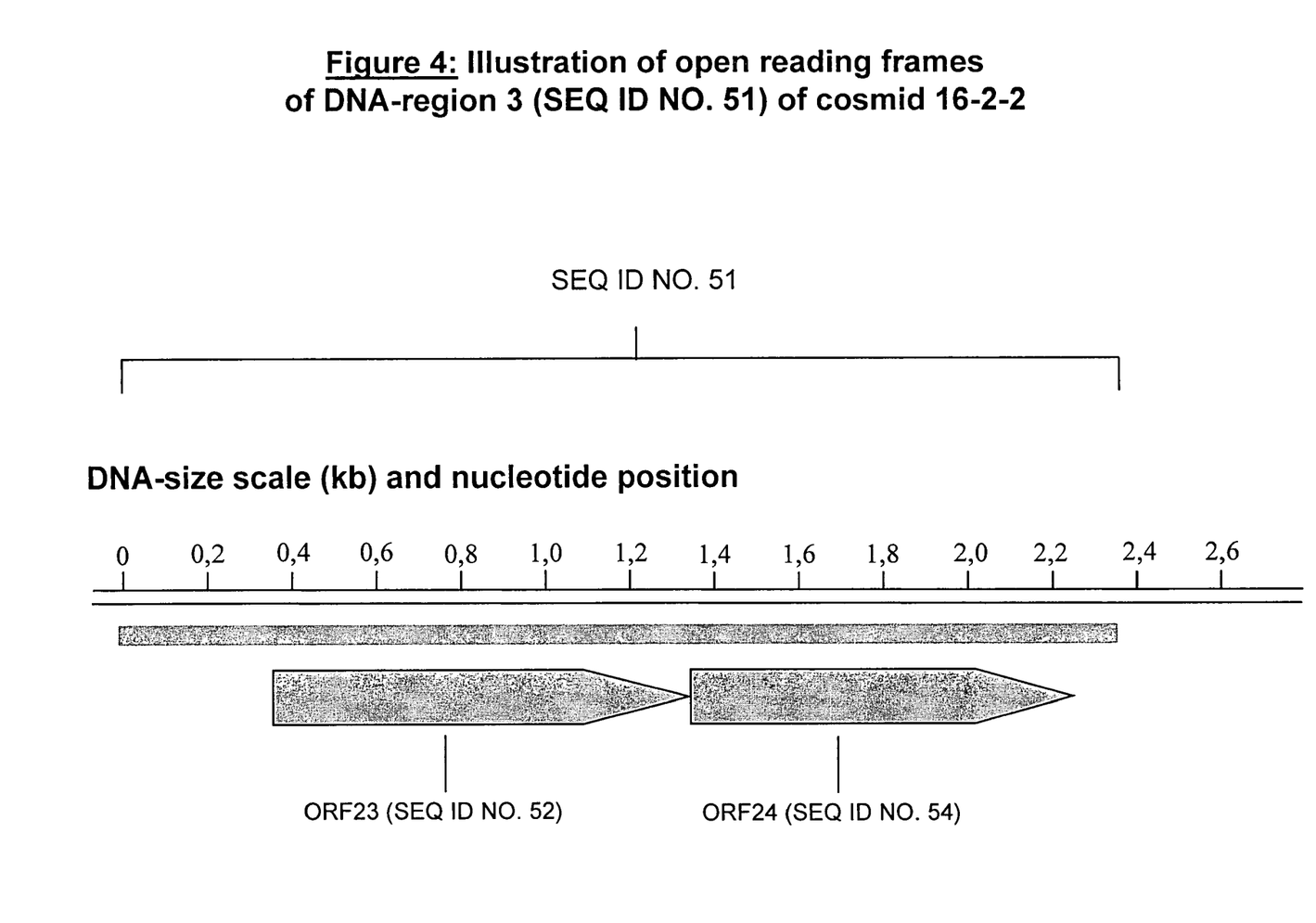
FIG. 4: Schematic representation of the open reading frames (ORFs) of DNA region-3 corresponding to SEQ ID NO: 51 on cosmid 16-2-2.
Figure 5:
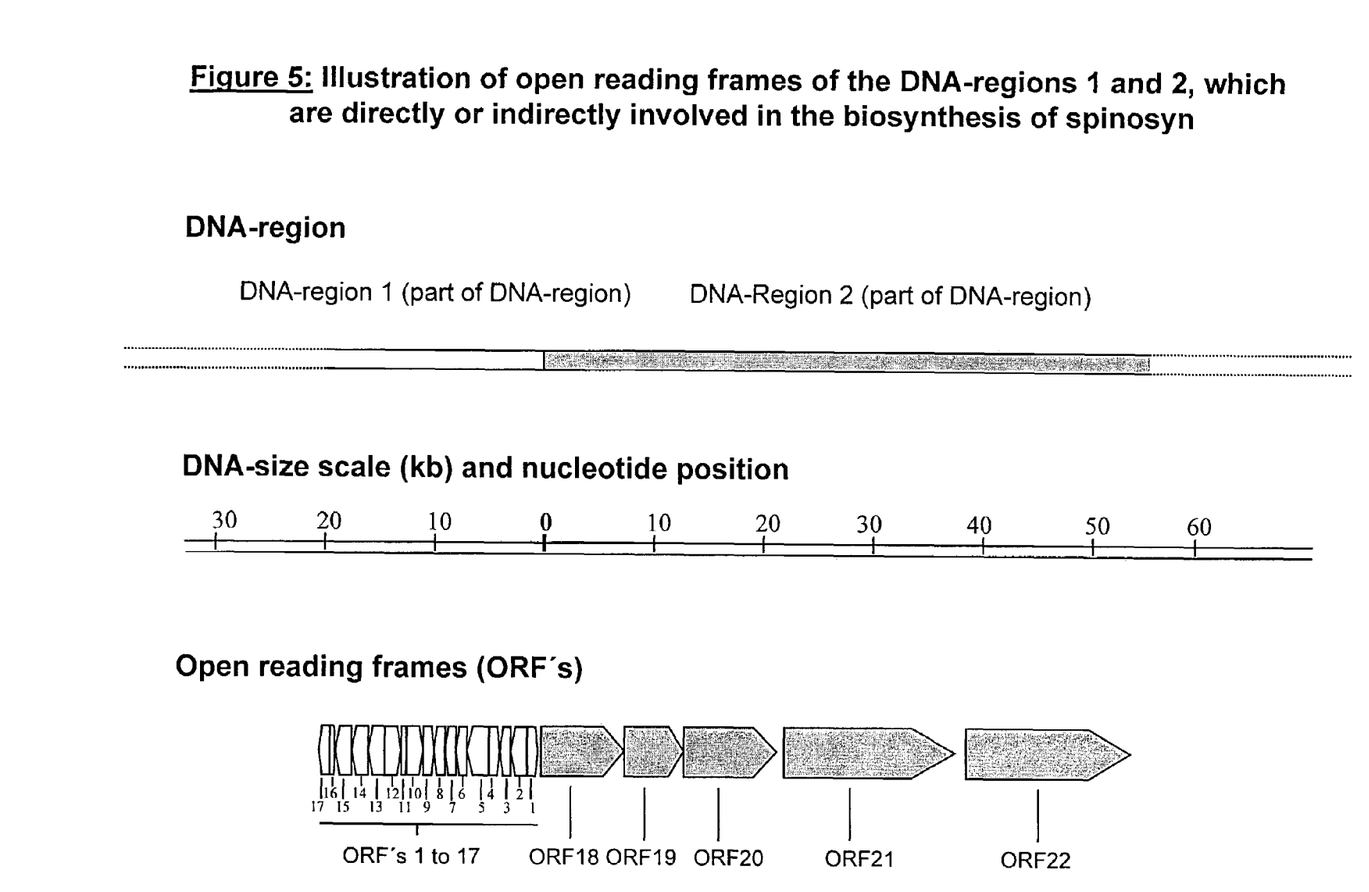
FIG. 5: Schematic representation of open reading frames (ORFs) of DNA regions 1 and 2. The ORFs are numbered from 1 to 22, corresponding to SEQ ID NOS: 7, 9, 11, 13, 15, 17, 19, 21, 23, 25, 27, 29, 31, 33, 35, 37, 39, 41, 43, 45, 47 and 49.
Figure 6:
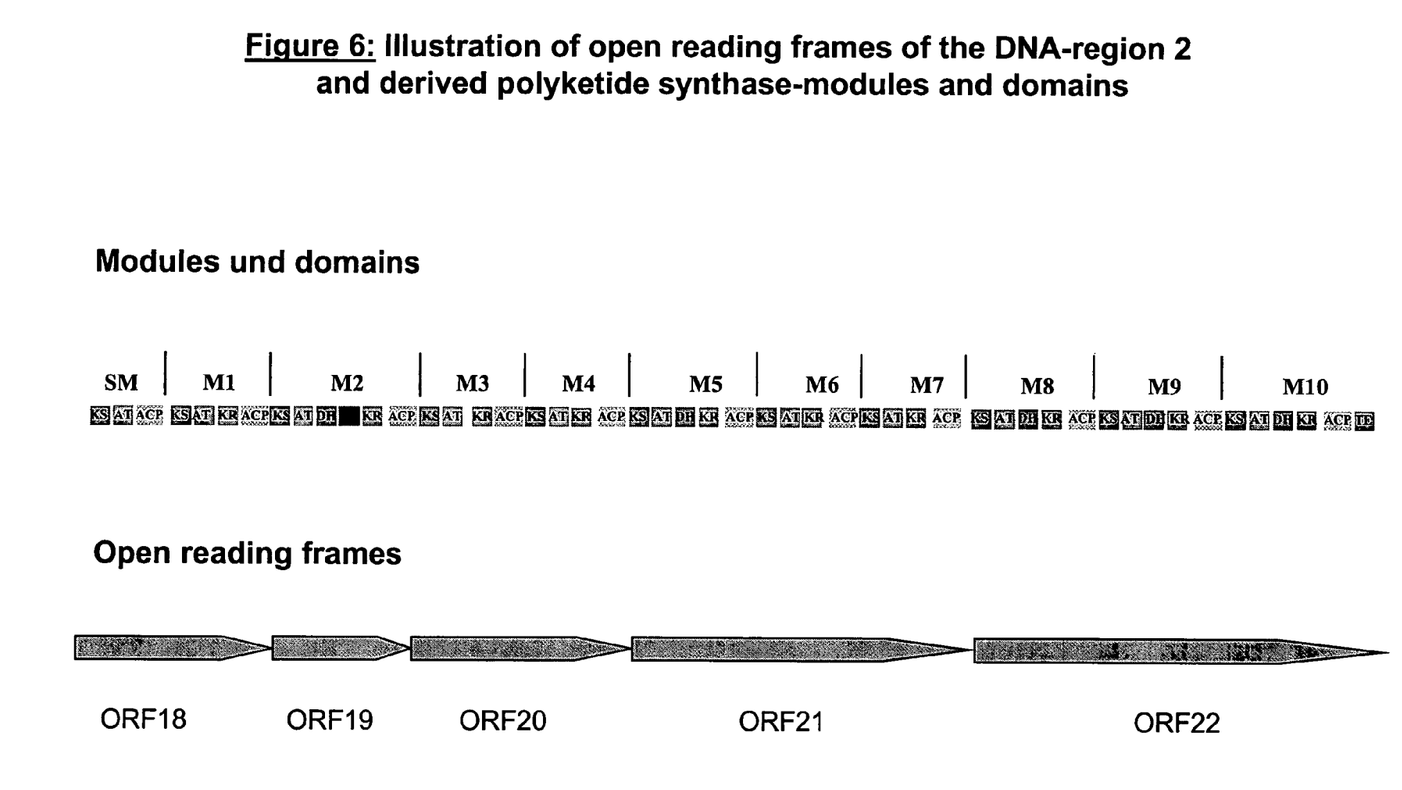
FIG. 6: Schematic representation of open reading frames (ORFs) of DNA region 2 (SEQ ID NOS: 5 and 6) and derivable modules and domains. SM, starting module; M1 to M10, module 1 to module 10; KS, β-ketoacyl:acyl carrier protein synthase; AT, acyltransferase; ACP, β-ketoacyl:acyl carrier protein; KR, ketoreductase; DH, dehydratase; ER, enoylreductase; TE, thioesterase.
Figure 7:
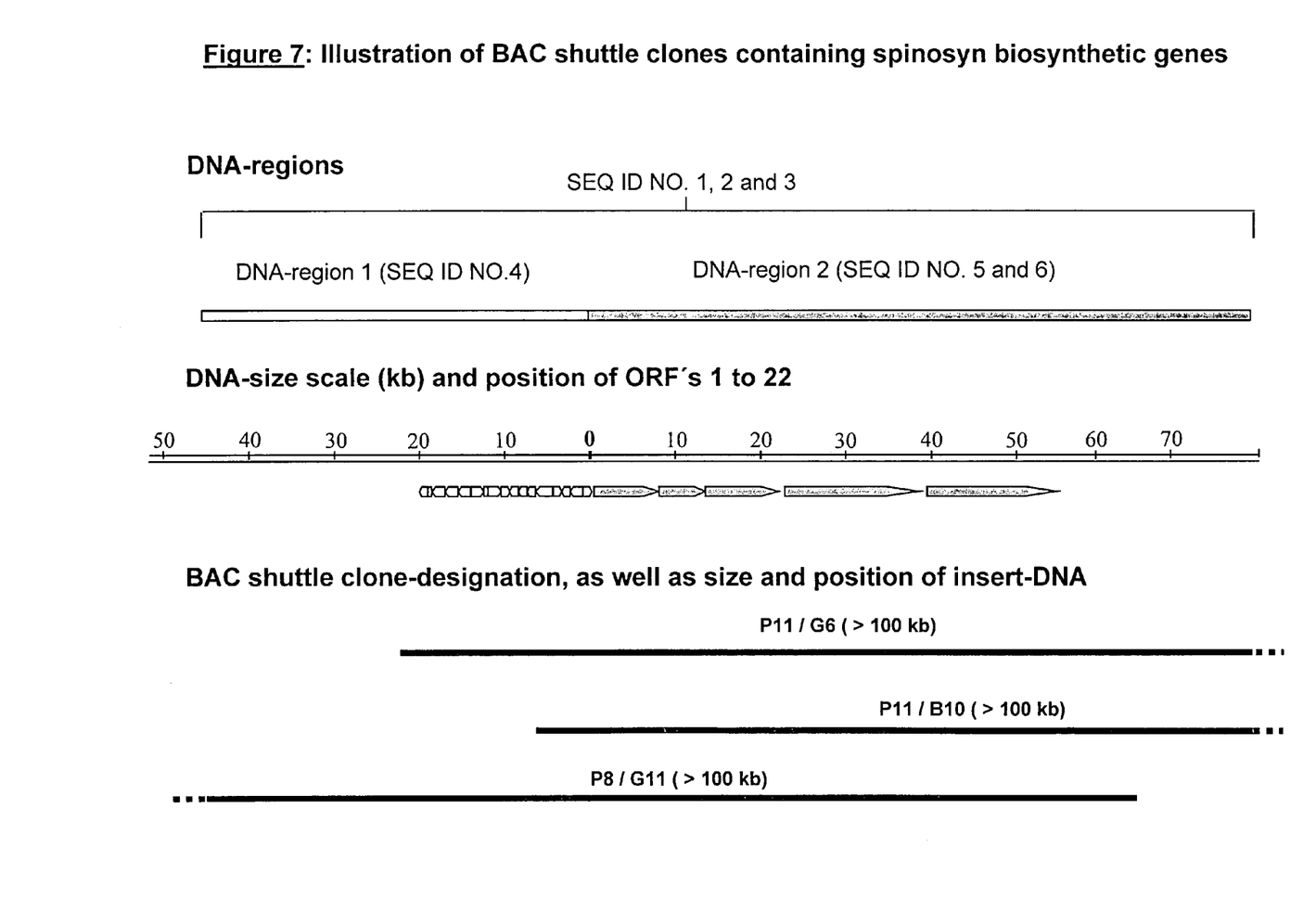
FIG. 7: Schematic representation of the location of DNA inserted in the BAC shuttle clone as black bars in the bottom part of the figure. The size of the inserted DNA is at least 100 kb. Unbroken bars: DNA sequence is identical with parts of DNA region 1 and the entire DNA region 2 (P11/G6 and P11/B10) or with the entire DNA region 1 and parts of DNA region 2 (P8/G11). Broken bars: DNA sequence is outside the sequenced region.

It is possible, for example, to use the nucleic acids of the invention for preparing novel spinosyn derivatives with modifications of the spinosyn aglycone by combinatorial biosynthesis. This may be achieved, for example, by exchanging the acyltransferase domain which is encoded by ORF 19 and incorporates an acetate unit for an acyltransferase domain which incorporates a propionate unit. Likewise, the ORF 18 acyltransferase domain incorporating an acetate unit can be exchanged for an acyltransferase domain incorporating a propionate unit. It is further possible for both or each of the ketoreductase domains encoded by the two ORFs mentioned to be inactivated, be replaced by an inactive ketoreductase domain or be deleted, and as a result a hydroxyl group can be produced biosynthetically at the appropriate position in the macrocycle. All acyltransferase, ketoreductase, dehydratase, enoylreductase, β-ketoacyl:acyl carrier protein and thioesterase domains may be replaced individually or in any combination by appropriate polyketide synthase domains with different substrate specificity or reaction specificity, may be fused to one another in any combination, mutated individually or in any combination, deleted or duplicated. It is further possible to exchange module-encoding sequences. Thus it is conceivable to replace the module 2-encoding DNA sequence (FIG. 6) for the module 1- or module 3, 4, 5, 6, 7, 8- or module 9-encoding DNA sequence (FIG. 6) and to express them functionally. It is also conceivable to exchange the module 2-encoding DNA sequence or any other module-encoding DNA sequence of the spinosyn polyketide synthase gene cluster for a different module-encoding DNA sequence of the spinosyn polyketide synthase gene cluster which incorporates a different biosynthetic elongation unit. Moreover, any other module-encoding DNA sequence of the spinosyn polyketide synthase gene cluster may be exchanged for a different module-encoding DNA sequence of a different polyketide synthase nucleic acid sequence from *S. spinosa* or any organism other than *S. spinosa* such as, for example, *Saccharopolyspora erythraea*. These modifications may be carried out by making use of ET recombination (WO 99/29837; Muyrers et al., 1999) or other cloning and recombination techniques.

The invention thus also relates to all module- or domain-encoding nucleic acids which are a natural or genetically engineered component of the spinosyn polyketide synthase.

The term "module", as used herein, means an arrangement of three enzyme-catalytically active domains which lead to elongation of the growing polyketide chain by a biosynthetic elongation unit. These domains are a β-ketoacyl:acyl carrier protein synthase domain, an acyltransferase domain and a β-ketoacyl:acyl carrier protein domain. A module may also carry a ketoreductase domain, a dehydratase domain, an enoylreductase domain and a thioesterase domain. A "loading" module at the start of biosynthesis is able to carry from the mentioned domains only an acyltransferase and a β-ketoacyl:acyl carrier protein domain and also an enzymatically inactive β-ketoacyl:acyl carrier protein synthase domain. A polyketide synthase domain comprises any one of these mentioned enzymatic activities.

Furthermore, the nucleic acids of the invention may be used for preparing libraries of recombinant polyketide synthase nucleic acid sequences, recombinant polyketide synthase proteins or recombinantly generated polyketides in the course of a combinatorial biosynthesis by rearrangement and expression of spinosyn polyketide synthase nucleic acid sequences or by combination and expression together with polyketide synthase nucleic acid sequences of a different, polyketide synthase-encoding nucleic acid sequence from *S. spinosa* or another organism such as, for example, *Saccharopolyspora erythraea*. These polyketides may be glycosylated by using the nucleic acids of the invention or by using other nucleic acids whose derivable products are involved in the biosynthesis of other sugars and coupling to the aglycone. It is known that aglycone glycosylation plays a decisive part in the biological activity at the site of action. The said modifications may be carried out both in natural and in genetically engineered spinosyn-producing organisms, in particular bacteria. It is furthermore possible to carry out the said modifications by making use of ET recombination (WO 99/29837; Muyrers et al., 1999) or other cloning and recombination techniques.

The nucleic acids of the invention, vectors and regulatory or genetically mobile regions may also be used for finding genes coding for polypeptides, which encode functionally similar polyketide synthases or functionally similar products involved in biosynthesis of a sugar.

Since the nucleic acids of the invention make up an extensive part of the *S. spinosa* genome, the nucleic acids of the invention may be employed as markers for the sequencing of the *S. spinosa* genome; this makes the arrangement of part sequences of a genome sequencing project considerably easier.

Thus the nucleic acids of the invention provide data which can be employed within the framework of a genome sequencing project and metabolic engineering, based thereupon, for increasing spinosyn production.

EXAMPLES

Bacterial Strains and Plasmids

*Escherichia coli* XL1-Blue MRF' and the cosmid vectors SuperCos1 (Stratagene, Europe) and pOJ446 (Biermann et al., 1992) were used for establishing gene libraries of *S. spinosa* ATCC49460 (American Type Culture Collection, U.S.A., EP-A 0 375 316). *E. coli* JM110 (Stratagene, Europe) was used for propagating plasmids which were transferred to *Streptomyces* by transformation. *Streptomyces albus* J1074 (Chater and Wilde, 1980; John Innes Institute in Norwich, UK) was used for heterologous expression of and biotransformation with spinosyn biosynthesis genes.

The plasmids pBeloBAC11 (Kim et al., 1996) and pOJ446 (Biermann et al., 1992) were used for preparing an *E. coli-Streptomyces* BAC shuttle vector.

Molecular Biological Methods

Molecular biological methods such as DNA restriction, agarose gel electrophoresis of DNA, ligation of restriction fragments, culturing and transformation of *E. coli*, were carried out as described in Sambrook et al., (1989). Plasmids were isolated using the Qiagen Plasmid Kit (Qiagen, Hilden, Germany). The enzymes used were from Roche Diagnostics GmbH (Mannheim, Germany).

Cultivation conditions and molecular-genetic methods for *S. spinosa* and streptomycetes are described in Hopwood et al., 1985. All *S. spinosa* or streptomycete cultivations in liquid culture were carried out aerobically in Erlenmeyer flasks at 28° C.

DNA-DNA hybridizations were carried out using the DIG-High-Prime DNA labelling and detection kit according to the manufacturer's information (Roche Diagnostics GmbH, Mannheim, Germany).

Growth media:

LB Sambrook et al., 1989

TS Difco order number 0 370-17-3 (Difco Detroit, Mich., USA)

R5A Illing et al., 1985

Preparation of a Cosmid *S. spinosa* Gene Library

In order to obtain an *S. spinosa* gene library, chromosomal *S. spinosa* ATCC49460 DNA was partially cut with MboI and fractionated by centrifugation in a glucose density gradient. Cosmid DNA (SuperCos1, Stratagene Europe) was prepared according to the manufacturer's information, ligated with *S. spinosa* DNA fragments of between 35 and 45 kb and packaged into phage particles with the aid of the Gigapack packaging system (Stratagene Europe). Transfection was carried out in *E. coli* XL-1 blue MRF'. Likewise, this method was used for the purpose of constructing a second *S. spinosa* gene library using the *E. coli-Streptomyces* shuttle cosmid pOJ446.

Sequencing of the Spinosyn Biosynthesis Gene Cluster and a DNA Fragment Outside this Cluster, whose Products, However are Involved in the Biosynthesis of Spinosyn The inserted DNA of SuperCos1 cosmids 16-1-8, 16-59-1 and 16-59-8 was sequenced. An approx. 4 kb gap between cosmids 16-59-1 and 16-1-8 was closed by sequencing a corresponding part region of cosmid 16-59-6 using primer walking.

An approx. 2.3 kb DNA sequence on the SuperCos1 cosmid 16-2-2 was sequenced.

Identification and Characterization of Chromosomal DNA Fragments from an *S. spinosa* BAC Shuttle Vector Gene Library, which Carry Spinosyn Biosynthesis Gene Sequences The BAC shuttle vector which can be transferred into and propagated not only in *E. coli* but also in actinomycetes such as *Streptomyces* was prepared by linearizing vector pBeloBAC11 with XhoI and preparing blunt DNA ends by applying Klenow polymerase. An approx. 6 kb DraI-EcoRV DNA fragment of cosmid vector pOJ446, which carries the replication origin of plasmid SCP2*, the apramycin resistance gene and also oriT for conjugative transfer, was ligated with the linearized BAC vector. The resulting vector was denoted pEBZ333.

A BAC gene library was established by starting from partially MboI-cut genomic DNA of strain *S. spinosa* ATCC49460 and the BamHI-cut vector pEBZ333.

Analysis and Annotation of OPEN Reading Frames of DNA Sequences Directly or Indirectly Involved in Spinosyn Biosynthesis Starting from the sequence according to SEQ ID NOS: 1 to 3, open reading frames (ORFs) which are directly or indirectly involved in the biosynthesis of spinosyn were identified. These ORFs were divided into two DNA regions which are denoted DNA region 1 and DNA region 2 (FIGS. 2 and 5) and which carry sequences according to SEQ ID NO: 4 or 5 and 6. DNA region 1 carries open reading frames whose products are involved in modification and tricycle formation of the spinosyn aglycone, whereas DNA region 2 (FIGS. 2, 5 and 6) comprises open reading frames whose products encode spinosyn polyketide synthase. The two in each case first nucleotides of these DNA regions are located immediately next to one another (FIGS. 2, 3 and 5).

Another DNA region 3 (SEQ ID NO: 51) is located outside this cluster of DNA sequences and carries open reading frames whose products are likewise involved in the biosynthesis of the spinosyn sugar trimethylrhamnose.

Preparation of the Spinosyn Aglycone and 17-Pseudo-Aglycone from Tracer®

Starting from 18.7 g of the commercially available product Tracer®, 8.92 g of spinosyns A and D were obtained in a ratio of 82:18 after freeze-drying and column chromatography on silica gel.

The amino sugar forosamine was hydrolysed with 2.7 N sulphuric acid in ethanol under reflux. In the process, the majority of the spinosyn A/D 17-pseudoaglycone precipitated. Besides further 17-pseudoaglycone, small to medium amounts of spinosyn aglycone were found in the filtrate, depending on the reaction time.

A complete hydrolysis to the aglycone was achieved under somewhat more drastic conditions (7.2 N sulphuric acid in methanol under reflux). The aglycone fraction contained exclusively spinosyn A aglycone. This correlates very well with the literature (Creemer et al., 1998) in which complete decomposition of the spinosyn D pseudoaglycone under corresponding reaction conditions is described. According to the authors, the reason may be that the 5,6 double bond in spinosyn D is protonated more readily, with the formation of a tertiary carbocation followed by rearrangements.

Thus it was possible, starting from 18.7 g of commercially available Tracer®, to prepare 3.0 g of spinosyn A aglycone.

Tracer (Dow AgroScience)
18.7 g

Freeze-drying

Spinosyn A/D (A, R = H, 82%; D, R = CH₃, 18%)
8.92 g

↓ 2.7 N H₂SO₄/EtOH
3 h reflux

69%

Spinosyn A/D 17-pseudoaglycone
(A, R = H, 82%; D, R = CH₃, 18%)

+

16%

Spinosyn A aglycone

64%

7.2 N H₂SO₄/MeOH
3 h reflux

Production of Spinosyn A/D from Tracer®

Freeze-drying of 18.7 g of Tracer® gave 10.0 g of a grey solid. After column chromatography of this solid on 800 cm³ of silica gel (eluent: dichloromethane/methanol 95:5), 8.92 g of pure spinosyn A/D (82% A, 18% D) were obtained.

-DC: $R_f$ (SiO₂, dichloromethane/methanol 9:1)=0.46.
-¹H-NMR: CDCl₃, δ=6.77 (s, 13-H); 5.88 (d, 5-H of spinosyn A); 5.80 (m, 6-H of spinosyn A); 5.49 (m, 5-H of spinosyn D); 4.87 (d, 1'-H); 4.67 (m, 21-H); 4.43 (d, 1''-H); 4.31 (m, 9-H) and others -LC/MS: electrospray, positive; peak at RT 44.0 min: m/z=733 (100%) [M+H]⁺ (spinosyn A); peak at 44.7 min: m/z=747 (100%) [M+H]⁺ (spinosyn D).

Preparation of Spinosyn A/D 17-Pseudoaglycone:

8.65 g (11.81 mmol) of spinosyn A/D were dissolved in 61 ml of ethanol and mixed with 104 ml water and 208 ml of 4 N H₂SO₄. After heating under reflux for 3 h, the precipitated solid (A) was removed by filtration and worked up separately from filtrate (B). The solid (A) washed with 1 N H₂SO₄, taken up in 140 ml of dichloromethane, washed successively with saturated NaHCO₃ solution and saturated NaCl solution, dried over Na₂SO₄ and concentrated in vacuo. Recrystallization from ethanol gave 3.03 g of spinosyn A/D 17-pseudoaglycone and mother liquor (C) The filtrate (B) was extracted several times with dichloromethane. The extracts were washed successively with saturated NaHCO₃ solution and saturated NaCl solution, dried over Na₂SO₄ and concentrated in vacuo. The residue was combined with the mother liquor (C) concentrated in vacuo and was fractionated by column chromatography on 650 cm³ silica gel (eluent: cyclohexane/ethyl acetate 1:1, then 100% ethyl acetate). Besides another 1.76 g of spinosyn A/D 17-pseudoaglycone, 0.78 g (16%) of spinosyn A aglycone were obtained. The total yield of spinosyn A/D 17-pseudoaglycone was 4.79 g (69%). -a) Spinosyn A/D 17-pseudoaglycone (82% A, 18% D); DC: $R_f$ (SiO$_2$, ethyl acetate)=0.48. -$^1$H-NMR: CDCl$_3$, δ=6.78 (s, 13-H); 5.88 (d, 5-H of spinosyn A); 5.80 (m, 6-H of spinosyn A); 5.49 (m, 5-H of spinosyn D); 4.86 (d, 1'-H); 4.70 (m, 21-H); 4.32 (m, 9-H) and others. -LC/MS: electrospray positive; peak at RT 40.7 min: m/z=609 (100%) [M+NH$_4$]$^+$, m/z=641 (10%) [M+NH$_4$+CH$_3$+OH]$^+$ (spinosyn A pseudoaglycone); peak at RT 41.4 min: m/z=623 (100%) [M+NH$_4$]$^+$, m/z=655 (8%) [M+NH$_4$CH$_3$OH]$^+$(spinosyn D pseudoaglycone). -b) Spinosyn A aglycone: DC: $R_f$ (SiO$_2$, ethyl acetate)=0.29. -$^1$H-NMR: CDCl$_3$, δ=6.80 (s, 13-H); 5.89 (d, 5-H); 5.80 (m, 6-H); 4.70 (m, 21-H); 4.44 (m, 9-H) and others. -LC/MS: electrospray positive; peat at RT 36.8 min: m/z=420 (100%) [M+NH$_4$]$^+$, m/z=452 (10%) [M+NH$_4$+CH$_3$OH]$^+$.

Preparation of Spinosyn A/D Aglycone 4.30 g (7.29 mmol) of spinosyn A/D pseudoaglycone were dissolved in 190 ml of methanol and mixed with 285 ml of 7.2 N H$_2$SO$_4$. After heating under reflux for 3 h, the cooled reaction mixture was carefully added to 1 700 ml of saturated NaHCO$_3$ solution. The mixture was extracted with diethyl ether, washed successively with saturated NaHCO$_3$ solution and saturated NaCl solution, dried over Na$_2$SO$_4$ and concentrated in vacuo. After column chromatography of this solid on 650 cm$^3$ of silica gel (eluent: cyclohexane/ethyl acetate 1:2, then 100% ethyl acetate), 1.88 g (64%) of spinosyn A aglycone were obtained. -DC: $R_f$ (SiO$_2$, ethyl acetate)=0.29. -$^1$H-NMR: CDCl$_3$, δ=6.80 (s, 13-H); 5.89 (d, 5-H); 5.80 (m, 6-H); 4.70 (m, 21-H); 4.44 (m, 9-H); and others. -LC/MS: electrospray positive; peak at RT 36.6 min: m/z=420 (100%) [M+NH$_4$]$^+$, m/z=452 (14%) [M+NH$_4$+CH$_3$OH]$^+$ (spinosyn A aglycone).

Forosaminylation of the Spinosyn Aglycone and Attachment of a Trimethylrhamnose Sugar to the Spinosyn Aglycone by Biotransformation with a Recombinant *Streptomyces* Strain Expressing Heterologously Spinosyn Sugar Biosynthesis Genes 20 ml of R5A medium (Illing et al., 1989) with 5 µg/ml apramycin were inoculated with mycelium of the recombinant strain *S. albus* (165-1) or *S. albus* (165-8) and incubated aerobically at 28° C. for 24 h. To this culture, 50 µg/ml of the prepared spinosyn aglycone (100 µl of a 1% strength stock solution in methanol; for preparation see section "Preparation of spinosyn aglycone and 17-pseudoaglycone from Tracer®", "Production of spinosyn A/D from Tracer®" and "Preparation of spinosyn A/D aglycone") were added and the mixture was incubated aerobically at 28° C. for approx. 120 h. As a control, *S. albus* (pEBZ340; vector pOJ446 with an approx. 1.8 kb, spinosyn-PKS carrying DNA fragment from cosmid 16-1-8) was cultured in the same way and mixed with spinosyn aglycone. After incubation, the cultures were centrifuged to remove cellular mycelium, and the supernatant (20 ml) was mixed with 25 ml of methanol.

35 ml of the culture supernatant mixed with methanol were in each case lyophilized, taken up in 15 ml of water and extracted twice with in each case 10 ml of ethyl acetate. The combined organic phases were evaporated to dryness and taken up in 350 µl of methanol. An aliquot of these extracts was analysed by means of LC/MS with positive ionization electrospraying.

The supernatant of the *S. albus* (165-1) culture contained a compound having the molecular weight of a forosaminylated spinosyn A aglycone and also spinosyn A.

Peak 1: RT=41.0 min: m/z=544 (100%) [M+H]$^+$, m/z=576 (16%) [M+H+CH$_3$OH]$^+$ (forosaminylated spinosyn A aglycone); LC/MS/MS: m/z=142 (38%) (forosamine fragment).

Peak 2: RT=44.2 min: m/z=733 (100%) [M+H]$^+$ (spinosyn A); LC/MS/MS: m/z=142 (21%) (forosamine fragment).

The *S. albus* (165-8) culture supernatant contained a compound having the molecular weight of a forosaminylated spinosyn A aglycone.

Peak 1: RT=40.9 min: m/z=544 (100%) [M+H]$^+$, m/z=576 (16%) [M+H+CH$_3$OH]$^+$ (forosaminylated spinosyn A aglycone); LC/MS/MS: m/z=142 (39%) (forosamine fragment).

The *S. albus* (pEBZ340) culture supernatant contained no compounds of MW 543 and no spinosyn A.

Forosaminylation of Spinosyn 17-Pseudoaglycone by Biotransformation with a Recombinant *Streptomyces* Strain Expressing Heterologously Spinosyn Sugar Biosynthesis Genes 20 ml of R5A medium (Illing et al., 1989) with 5 µg/ml apramycin were inoculated with mycelium of the recombinant strain *S. albus* (165-1) or *S. albus* (165-8) and incubated aerobically at 28° C. for 24 h. To this culture, 50 µg/ml of the prepared spinosyn 17-pseudo-aglycone (100 µl of a 1% strength stock solution in methanol; for preparation see section "Preparation of spinosyn aglycone and 17-pseudoaglycone from Tracer®", "Production of spinosyn A/D from Tracer®" and "Preparation of spinosyn 17-pseudoaglycone") was added and the mixture was incubated aerobically at 28° C. for approx. 120 h. After incubation, the cultures were centrifuged to remove cellular mycelium, and the supernatant (20 ml) was mixed with 25 ml of methanol.

35 ml of the culture supernatant mixed with methanol were in each case lyophilized, taken up in 15 ml of water and extracted twice with in each case 10 ml of ethyl acetate. The combined organic phases were evaporated to dryness and taken up in 350 µl of methanol. An aliquot of these extracts was analysed by means of LC/MS with positive ionization electrospraying.

The *S. albus* (165-1) culture supernatant contained traces of spinosyns A and D.

Peak 1: RT=44.2 min: m/z=733 (100%) [M+H]$^+$ (spinosyn A); LC/MS/MS: m/z=142 (8%) (forosamine fragment).

Peak 2: RT=44.7 min: m/z=747 (100%) [M+H]$^+$ (spinosyn D); LC/MS/MS: m/z=142 (37%) (forosamine fragment).

The *S. albus* (165-8) culture supernatant contained traces of spinosyns A and D.

Peak 1: RT=44.1 min: m/z=733 (100%) [M+H]$^+$ (spinosyn A).

Peak 2: RT=44.7 min: m/z z=747 (100%) [M+H]$^+$ (spinosyn D).

Deposition of Microorganisms

The following microorganisms and plasmids have been deposited with the Deutsche Sammlung von Mikroorganismen und Zellkulturen GmbH (DSMZ), Mascheroder Weg 1b, D-38124 Brunswick, in agreement with the requirements of the Budapest Treaty.

| Microorganism and plasmid | Deposition number | Date |
|---|---|---|
| *E. coli* XL1-Blue MRF' with cosmid 16-1-8 | DSM 12961 | Aug. 2, 1999 |
| *E. coli* XL1-Blue MRF' with cosmid 16-2-2 | DSM 12962 | Aug. 2, 1999 |
| *E. coli* XL1-Blue MRF' with cosmid 16-59-1 | DSM 12963 | Aug. 2, 1999 |
| *E. coli* XL1-Blue MRF' with cosmid 16-59-6 | DSM 12964 | Aug. 2, 1999 |
| *E. coli* XL1-Blue MRF' with cosmid 16-59-8 | DSM 12965 | Aug. 2, 1999 |
| *E. coli* XL1-Blue MRF' with cosmid 165-1 | DSM 13005 | Aug. 18, 1999 |
| *E. coli* XL1-Blue MRF' with cosmid 165-8 | DSM 13007 | Aug. 18, 1999 |
| *E. coli* DH10B with the BAC shuttle clone P8/G11 | DSM 13012 | Aug. 18, 1999 |
| *E. coli* DH10B with the BAC shuttle clone P11/B10 | DSM 13011 | Aug. 18, 1999 |
| *E. coli* DH10B with the BAC shuttle clone P11/G6 | DSM 13010 | Aug. 18, 1999 |

REFERENCES

Biermann M., Logan R., O'Brien K., Seno E. T., Nagaraja R., Schoner B. E. (1992) Plasmid cloning vectors for the conjugal transfer of DNA from *Escherichia coli* to *Streptomyces* spp. Gene 116: 43-49

Chater K., Wilde L. (1980) *Streptomyces albus* G Mutants defective in the SalGI restriction-modification system. J. Gen. Microbiol. 116: 323-334.

Devereux J., Haeberli P., Smithies (1984) A comprehensive set of sequence analysis programs for the VAX. Nucleic Acids Research 12: 387-395.

Mertz F., Yao R. C. (1990) *Saccharopolyspora spinosa* sp. nov. isolated from soil collected in a sugar mill rum still. Int. J. Syst. Bacteriol. 40: 34-39.

Creemer L. C., Kirst H. A., Paschal J. W. (1998) Conversion of spinosyn A and spinosyn D to their respective 9- and 17-pseudoaglycones and their aglycones. J. Antibiotics 51: 795-800.

Fishman S. E., Hershberger C. L. (1983) Amplified DNA in *Streptomyces fradiae*. J. Bacteriol. 155: 459-466.

Hopwood D. A., Bibb M. J., Chater K. F., Kieser T., Bruton C. J., Kieser H. M., Lydiate D. J., Smith C. P., Ward J. M., Schrempf H. (1985) Genetic manipulation of *streptomyces* a laboratory manual, The John Innes Foundation, Norwich, 1985.

Illing G. T., Normansell I. D., Peberdy J. F. (1989) Protoplast isolation and regeneration in *Streptomyces clavuligerus*. J. Gen. Microbiol. 135: 2289-2297.

Kim U. J. Birren B. W. Slepak T. Mancino: V. Boysen C. Kang H. L. Simon M. I. Shizuya H. (1996), Construction and characterization of a human bacterial artificial chromosome library. Genomics 34: 213-218.

Kirst H. A., Michel K. H., Martin J. W., Creemer L. C., Chao E. H., Yao R. C., Nakatsukasa W. M., Boeck L. D., Occolowitzh J. L., Paschal J. W., Deeter J. B., Jones N. D., Thompson G. D. (1991) Tetrahedron Lett. 32: 4839-4842.

Motamedi H., Shafiee A., Sheng-Jian C. (1995) Integrative vectors for heterologous gene expression in *Streptomyces* spp. Gene 160: 25-31.

Muyrers J. P. P., Zhang Y., Testa G., Stewart A. F. (1999) Rapid modification of bacterial artificial chromosomes by ET-recombination. Nucleic Acids Research 27: 1555-1557.

Nakatsukasa W. M., Mabe J. A., Michel K. H., Martin J. W., Paschal J. W., Elzey T. K. (1990) Abstracts of 2nd Int. Conf. on Biotechnology of Microbial Prod.: P-21.

Sambrook J., Fritsch E. F., Maniatis T. (1989) Molecular cloning—A laboratory manual. Second edition. Cold Spring Harbor Laboratory Press.

Shizuya H., Birren B., Kim U.-J., Mancino V., Slepak T., Tachiiri Y., Simon M. I. (1992) Cloning and stable maintenance of 300-kilobase-pair fragments of human DNA in *Escherichia coli* using an F-factor-based vector. Proc. Natl. Acad. Sci. USA 89: 8794-8797.

Smokvina T., Mazodier P., Boccard F., Thompson C. J., Guérineau M. (1990) Construction of a series of pSAM2-based integrative vectors for use in actinomycetes. Gene 94: 53-59.

SEQUENCE LISTING (55 sequences)

SEQ ID NO: 1 - DNA, 50000 bp, Saccharopolyspora spinosa
ggcaccaccccggggcccccgcctcactcggagtcgatccgcattccggtcacgaacatgtgacccgtcgagtgcgtgatcattagctcggtcttcgcctcgatcgccgcctgctgcggggtcacgccgcaggcccagaacaccggcacgtcgcccggctccatacgcactcgttcaccccagtcaggttcatcaacgttgtcgatgcccaacttctcaggggagccgatgtgcacggggcccccgtgcacctcgggatgcgcatgcgtgatggtgacagcctccgccacccggtccgggggcatgggacgcattgaaaccactagcttcccccggaactggcctgcgggcacacactcacggttgctgaggtaaaccgggccgttgatcccctggtcgatgtgccggatcgggagtccggcatcgagcagcaagtgctcgaaggagaagctgcagccaagcaggaacgcgaccatgtcgtcggtccacaggtcaacgacgtcactgcgctcctccaccagcgccccttcccggtacacgctgtatttgggcaggtcggtgcggaggtcagcaccaggggcggtcagcttcggctccggatctcccgcgtcggtgacctcgaggatcgggcacggcttggggttccgctgggcgaaccgcatgaagtcgaacgcgtcatcctggggcagcatcacgaggttggcctgcacgaatccatgacagatcccggacgtgggcctcgcccacgcattcgcgcggttggcacgccatgcctcgatgggctccgcgtgctgcagatcaacgaactccatcgatgacttccccttcccggcgatgatgacgaaggctggcaaccgagggttgcccgctacgggtggccgtcactggtctgccacccaggggtcgccgagcaggctctggtgaacgattccggagatcagctcggcatgcgcggcgacgaaacgcagtgggatcccgtcgtcgccttggaacgcgggatcgtcaacgccgccgctgcgtagacctgcgcgcagccccagctcggtccactcgcgcaccagatccccggtgactgccaggtttgcgcgtcgagccaggatggccaccgcaccggtgatgacgtagcagcccaaattcgacacggatgcaggcagcagatgatccaccgtcgtggacgcgaagaatccgccctcaacgctgacgcctcgcggagtcagcgcctcggactcggcggcaatgttgccgaacccgatctcgttgccgttgtctcccacggccagcgtcagagcaccgttgtccgtggcggcgcgaaggtagtcgtcggcaaacagatcaccggcggtgaccggcgtgccccagatcagatgacggccgccaacagagttctgccccagcttctcgatggcggcgacgacgccgaactgcgccgcgaactcccgggcctcggccgcgctggagaatcgggactccatcaaggtcacgccatccaggcccgcagcgtcgaccagcttctccaccgggccgacggcctctgggtcgatgacgatggtcacctcgctaccaagaccggcgagcgtgcgcgcgagtgccagagagccgatggggccgtccacctccccctgcgggaaccggccttcctcgaccagacccgtgacgatcaacgccttttcaccctgtcgacgcagcagagagcgcgcgatcgcaaggctgatcggctccgaccgctcaccccgcgccagcgtgtagaacgggctcacgatgccggccgggctcgtcggcggacgcatctcgatcgtggccagtcgatccaggctctcgaaggccgggtgcgactcgggcttcatcagctctccctcggtatacgacatatcccaaggacttcatccgctacggagtcccgcctcgggcggttgcttacgcggtgaggaccatataccgtattccactgtccaaggaagggggacgatggaaccgaatcagccacgcactgcgggcacgctgaacatggtggagctgcaccatcgcccagccgccgcagactccgcggtggggtccggcaacggtatgctcgcacccctcgacgcacgcgtcgacaatctgacagatcgggtcttcgaggccatccgcgacagcatcgtaagtcaggcactcccacctgggcgtcgtgtgagcgaggccaagctcgcggccgagctgaatgtcagcaagacccccgtgcgcgaggcgcttctccgcttgcggcacgtgggcctggtcgaggctgccccgaaggggctgcgcgtcatcagcgcctcggtccgcgccattcgcgacgcctacgagcaccgggcggggctggagagctcggcagcctggttcaccgcacatcgggctaccagcgcccaacgggagaggctccacgaggtcgccacctcatccctgcgcgcggcagagtccggcgactccgcccagttccgcgccgaggatcgcgtcttccaccacatcatcgccgagttctgcgggaacgagatcctccagcgcgcggtcgacaacgccctggtgctgaccgctgtactccgagaacgcgacactccctcgaccggtgactccatctcctgcgcctcggagcacatcgcgacggcatccgccgttctggctggcgacgccgaccgggcagcccggaacaacgccgaccacatcctccacgtgatgtcgcttgtcctctcctcacacacgcagcgcgggaacgtgcccccgggaacgagttaaaccaactcccccaccccctacctcaccattcgaccgaaggacgggctttcgtgaccgagcacctggcgaccatcaccgctgcggaaggagagatccccgttgtcgtgagcgaccgcggcgtcgcagcaatccgggagatagaccccgagctggcggtcacgaccatcatggacgtgatcgcaggagaccacctcgcgcggctgcgtgagcgtgtcaagaacgcccccgacctcgccttcacacgcgtggacgaggtgcggttcaccgcgccgtaccgatccccccggaagatctggggcatcggtctgaactacggcgatcacgcagcggacctgagcgagtcggcgcccgaccagccggcgtccttcgtgaagtgcgaccacacgatcatcggcccggatgagccgatcgtgattccggcgcagagtgagcgcaccacgtccgaggctgagatcgggctcatcatcggcaggacttgcgagaacgtcagcgagtccgaggcgatggactacgtgtggggggtcacgaccatcctggaccagaccgccgaggacatcttgcggatcaatccgcgctatctcacccgctcgaagaacttccggacgttcttctgcttcggaccggagctcgtaccgctcgatgaggtgatagagaagttcgaaagcttggacgacatcgagatctcgacggtcaagaacggcgatgagttcaggaccaacacggtcgcccacatgacccacaagcccgccagcctcgtgagcttccactcgaagatgatgccgctgtttccgggagacatcatctccaccggaacccctggcgcgctcgtcatcggcgacggagaccgtgtggagtgccggatcgacggcatcggtcagctgaccacgacggcgcgaaaggccactacacgatgagcactcacgcggtcgagcagctcgaccggacccgactcctgcaatgtgccgacgacctccgcgagaccgtcctcgacgacgcactcaagggcgtgcccctgggtgctcgtgtgctcctcggagaggtggaccagcagaactggaacgtggcccgcggagacctcgccctgccggtgaccacactccacgcacgcgctatgaacgccaacctggcgactatggaggcgtactgcgagcgcaacaacgcgcttctcgccccgcacggcaagaccaccatgtcaccccagctcttcgcccttcaggcgtctcacggtgcgtgggcgttcacggcagcgacgcccactcaggtggccgtgatgcgccgctacggggttcagcgcatcatcctggccaacgaactcgtcgatgctcccgcgctgcgttgggtgactgccgaaatcgccagcgacagctcgttcgacttctactgcctggtcgacgatgcggacacggtgcgggcgatgtccgataccatcgccgactccggccacggggtcaccctcaacgtcctcctcgaggtcggagtgcctggtggcaggtgtggcgtgcgagacctcgactcggcgctcgaggtcgccgcggcggtcgccgcgaccgagcatctccggctggtcggcgtcgaggcctacgagggcctcgtgaccggcggcatgacaccggaggacctccatgcactcgacaccttcttcgctggcgtccggtcgatcgtgctcgagctggcacgtcgcgacctgttcgacgccaaccgcatcatcgtgacggcaggcggaagctcgtacttcgatcgtgtcgtcgccggactcggctcgtgggacggtgtccgcgacgacgtggacctagtgcttcgaagcggctgttacatctcccacgacgccggcaagtacgaaaagctctcgccgctcgctggccgacgggccgagcaggaaccgctccggctccacaacgcactcactgcatgggcttccgtgctgtcccggccggagcctgatctcgcgatcctgtcgatcgggaagcgcgacgcggcccatgacctgacgctgccacagccacgcgagctgtttcgcgcggatggctcgaggcagcggctgcgggaagcggagacgttcaagctgatggaccagcacgccttcgttcgcgttgcccccgggctcgcgatcgctcccggagacatcgtcgctttcgacatgtcccacccgtgcacggccttcgacaagctccccttcatcccgatcatcgacgacgacttcaacgtcgtcgacggcgtcctcacgttcttctgacggggctcaggacctcctacgggaggctccggttgaaccgaccccacaagctcccgaagtcagttggacatgaccaccagccacagagaggccccgacaccgtgtcccgtcaggcgttcacagacgtcgaccttcctcccgcgggaggcccttactccgccgccgtacgcatcggcaacatcgtggcaatcgccgggcagtgcggctacctcgccgacagatccctcgcaccgggtggtctggaacctcaggtgcgccgggcattcgagaacctcatgaccgcgctgcgttcagccggctgcagcgaggcagacgtgatcaccgtgaatgtgttcctcgctgacggggacgacttcgacgcgatgaacgcgatctaccgcgagtacttcagcgagcccggcccggcccggacgaccatcaccgccggtctccgacccggtgtcctgttcgaggtcagcgctcaggccgtggtaggcggctgaccgggccactgccactcctcccaccaatgtccctccatcaacggcgtgccacgactttccgggccgccgtcacccgaaaccgcaaggacatgtcatggatctcgcaatcaatggaagagtcgccctcgtactcggagccggcggcggactcggttcggccattgccgcctcgctaagccgggaaggcgcgcgtgtggcgctggccgacatcgacaaggacgcgctcacggaggtcgaggcgtccatgaccggcgataacatgagcctggtctgggacttggcgaacctgtcggtcatcgatgagaacgtcaccgccgtcgagagcgagctcggcccggtggagatcctggtcaacatcaccggcggcccgccgcccacccgtgtgtccgggcaggacgccaccctgtggcgtcggcacttcgaggcgatgatcctctccgtcgtcgcgatcacagaccgcgtgctcccgggcatgaccgagcggggatggggccggatcatcacgtcgacttcgtccggcgtcatcgcgcccatccccaacctcgggttgtcgaacgccctccgctcgagtctggtgggctggtccaagacactgtccggtgaggtggcaagcgacggcatcaccagcaacatcgtcgttccggggcgcatcgccactgcgcgcatcgcccagttggaccaggcaaaggccgcacgggagaaccgcactgcggagaacatcgcgagggaatcagagagctctattccggtcggccgctacgggcggcgcgaggaattcgccgacgcggtcacatttctcgccagcgagcgtgccagctacatcaccggatccgttgtccgtgtcgatggcggactgctccagaacgtgtaaccccgacaaacatcctgtctccagatcagcgcaacccgaagccatgtccgctcctcggggtcactgacgtcagcgatcccgagcccaaactcatcacctacgtgcgctgatctacggtcatccagggctacccactcgccagcgggatcacgatcagcagcacggacctcgcctccagggtgcacgctgcgcgcgagcggtgccgtcggttttcgggtcgccggcgacccagcttttccccacattgaaagctatccggaaccggatgctgcctggaaggcgtacttcaggtatggatgcccgaacgcgaccttcagctacctacgatcgtatctctggaaagaggtcgtccggtggcaggagcgcaaacaccggcgtactccctggaaacagctacgccgacgctacggcatccagccagccgacggcgatgtcgggctgttcgatccggaaggccggctcgggagacgtgcagccgggtggggaaggagcgctgacaaaatcctgacgacctggcactaccaggacagctcgtgggcaagcgagatcaggcggggtatgcgaaacctccgatcttgctaacagtcaagcggcgacccgtttcatggtcgtgtaatcctcgcggccacccgcgctggcctcacgtctgtgcgccagcggaaatgtcgcacaggcgcggtattcccgaaaggaacccatcgaatcatgacgaaccgtcccttccgctggtcgctcgtgggcgccagcgacatcgcccgcgcatttgtaggcccagcgatctccgcccagcctgacgccgcggtggtcagcgtcgtcagcggcgacctggcccgagcgcaggatgtagcggcaccattcggcgcccggggccatgacgaactcaccgtggcgcttagcgatcctgacgtcgacgccgtgtacatctcgagtatcaactcggcacatcacgatcaagcacttgcggcgatcgcagccggcaagcacgtcctgtgcgaaaaaccgcttgccctgaccgtcgccgaggcacaagaacttgtcgatgccgcggagaaggcaggcgtagtgttcgcgacaaaccaccacatgcgcaactccgtgccacatcgtttgatccgggatgcaatcgccgccggcgacatcggcgagccggtcgcagtgaacgtccggaacgcgatccgactgccgcccgccgcgcggagatggcggacgaccgattcggcagcgggcgccggagtcgcactcgacctcacggtgcacgacgcggactgtctccggttcgtactcaatgccgatccgctaacggtcgtggcccatacctcgtccggccacatgacgagggtgggaatcgatgagacaatctccggaagcgcggagttcgtcagcggtgtgcatgcttcattcgtggaaagcttcgtgaccggacatgcccccacatgcctggaggttttcggaaccgaaggagcgctcatcggcacgggtatccagtcgatgtcaccggtcggcacgctgacacacgtcggtccggccgggtccaggaagatcgatctgggtacccgcgaggacctctacgtcgtgggtgttcgacggttcatcgaggctgtgcgtggcgaggccgagcccccggcctccggccaagacggggtctggtcgttggccttcgcacgggcggcgctggaggctgctcggaccgggcatcggcagactgtgggacaggctcgatgacgaaagctgggcgcagttaggcacaacagatcatgcacaaggacaaccgggcatcggcagacgtggcgatcgtcgggtccggtggaggctgactgatcgtcgccggggcgctcgctggtcgcggactcgatgtgctcgtgttggaacgggacgagtttttggctcaagagcccgctatcgacgtgtgcaaggcttcgcgcacgggcactacaagccggacgaacggtggctcgatggtgctgggagaccgttcacaccggctactcactactcgtcggcggcaacagccaaggcctacgaagctggcccgtggctcaatctataccgcgtaagctcgccaacgggtcctatgtgggcggccgcaactacatgcagcacccgaactccgcggtcatggccatcggcaatggccagcctccgatcatggaccatacctacttcaacatgcgccgttgcgggggccgcggacgattagctgaagcggatgtccgctttcggtatcgcagaccttgccacgacgggcggtgttgccgggccgcgaacggatcatgtgagccgggctggcccgagaagggcatgggccaacagagcaggtgactacgttatctctgcccggtcatccaactgatgacctgtgcgcgcgaggtaaagcccagcttggaaaggatgttctcgacgtgggcctcggctgtgcgctgggaaatgaccaggtcagccgcaatctctttgtttgttttgccagcggtgaccagggcagcgacctcgcgttctcgttttgtgagaaccggttcggtttccggagccgaagcggcggccgcttcgaccggcggtggcttctccccaagagcatagaagatagtctgctcccggttcatccgcgtcccctggcctcgggcggtttcgtattcggtgtctgtgagtgcttcctgggcgcgtgccttggcctgctcacgccaggtcagtagcgtctcggatccgaacagcggggtgccaatcagttcccacattttatccaacgccccgaaaaggatcgccgcgcgttcaggattgcgttctgcggcggcgacccaggccagcagttcaacgcagtcgctgatcccgagtaggtcgttgagttcccgcttattgcggagggacctggacgcggaggcggctgccttggttgggtcgcccgcggcccaccaagtgatcgccatgttccactccgcccacgatagcctccagcgctcgccaagttctgtacagatcttgcggcattcgtgcagaaggaccatcgcccggtcaaggtctccaagcaggcccgctgcctgcgctcgtattgagaaaatggctaaggcggggccggtccagtggccagttgcgcggtggcgggccagtgcctcgtcgagcagttgcgtggcgcgagtcaggttgttgtcccacatctcccggtcgccaagaaactgagtcgcgtaggtaaattccgtttcgtcgcccagtttccgggccagctcgcggctttcgttaagcaggaccagcgccccatctcggtccccttgccggtgggcaatccatccggtgatccacagtgcgcgggcacgctggctggtgggttcggtctccagggccaacgccctgtccagccacatgcggccctccctcagatagtcgccagcagcccagtagaaccacagcgcgctcaccatccgcaacccaaccgacgcctcgccaggtgtggtgaagcagtagtccaacgctgcccagaagttgccgcgctcggcgcgcagacgcgcgagccaaccggcttgatgcgggcccgcggactcggcatcggactgctcggcgagatgcaggtagtagtcgcggtgccggcagcgcagagcgttttcggcacccgcctcggtgagccggtcgtgcccgtattgacggatagtctccagcatccggtatctcgtcttcgtgcgctcctcggtccgggtgagcacggacttgtcgatcagtcccgcgagagcggcgaagacgtcatcatcggtcagcccgtcgccggtgcagacgttttcggctgcgtcgagatcgaattcgtcggtgaaaaccgaacagcgcgcccacaactgcttctcatgctcattgcacaggttgtagctccagtcgacggcggcgcgcagggtctgatgccgaggatcgtcggcgcggtcgccggtggtgagcagccggaatcggttctccattcgcgttagaatttgcccgactgagagcacgcgaacgcgcacggcggcgagttcgatcgctaggggaatgccgtccagcctccggcataacctggccacgatctgttcgttttcttcgttgatggtgaaccctggtagcgccgccgcggcacgctgctcgaacaaggtcaacgcttcacgctggtagggacgaccttcctgttgtgacgttgatgaatcgctgccagcaggcacggacagtggcggaaccggccaggtctgttccgccactatccctaaatgttctcggctggttgcaagtatccgcaaccgcggggccgcggccagcagcacagcgactaggcggctgcaggcccccagcaggtgctcgcagttgtccaacaccagcaagacttgcttgtccgccaagtaatcgacgagcacggcctccggggcacgtgtcgaacggtcatggatcccaagagcagccgcgaccgcctgcggcaccagcatgggatcgcgaacgttagccagctccaccagaaatgtcccggcggagaaggcccgccgcacgtcgtgtgcgacgtgcagcgccagccgggacttcccgatcccgccgaaaccagtcagggtcactaaccgtgaactggacagcgcgcgcttaactcttgtggccgcctgacggcgccccacaaagctcgtcacctcatatgggaggcgaccagcctcccgaaccgcaaccccagacacgactcaccgcacctcggtagaactagcgttttattgtagcccggtcatggctggcagcgcacttacagcttgaacaactgttcgaaccacttcgaacccaccgacggggttcgttacgatctcggccgatgttgatcgtggtgggtgcggggagggcgtgcgttgcccgctggcctgcccagcctgtaccactgatcaaggtcgccgaccgggcccgtgtgggcgatgttggcactggtcaggccactgctggcggttatgcggcgggccagctgcggcggcacggtgggcggcatccgctccgctactggtgcgcgaaggccgtcgcgtccgcctgacggcgaaaggtgagctcgtcgtggaggcagcggaccgggtgatcgctgagctggagacgctgcgcactcagatcaatcgctcacgtggcgagatctcgcaacgtctgcgtgtggcctccatgcagaccgtcaccttcatcctgttccccgaggtgctgactcgtctacgccggcggcgtccaggactggatgtggtgattgttcaagccgagccggatgcggctcttcagggtctccaggtcgacgactacgacctagtgatcgccgagtcctacccgcagtggccggtcatctatccggacgggctcacgacagagatcctgatgaccgaccgcatgcacgtcgccgcagctcccattgtgggtccaccgcccgtcggctgggggcaggcgctttcgccgctggcgagtcgttcaccgctctcggcgctccaacgtcttgcctgctcgaagttgtcccgagtcgggcccgacgatggctgtggtgaagggatcttgacgctcatgcatggaggttcaccattgttggagcaagaggctgatgacggtggcggcggtcgttgcgccagcggcgatcatccagccgtgtgggagtagcgggctggctccgaagaattggctcaggccgggagtttggacgacagcggccagtgccacgaacgagacaagcgcacacgccatgaccagtggtgtccgtccgcgcacgaccagggtctgtccgagctgggcggcgaccagcgccacgagcgcgaccgtgttggcctggcgcagggttccggtcgccctgcccaggatccacgcacaaatggcggccccggcggtgaccgcggcgcggcggtagatgtcgcgggtcagcgcagcgcccagcgaggcttcggggccttctgccagcagcatctccgcagtgatcgtcgggggtggtcgcaccgcgatcgccatcgccgggaggatgtcggtgagcaggttgaccagcagcaactggcgggcgttgaggctgcccccgccgttgatcacaccggtgacgacggtgaagccgatctcgccgaggttgccgccgagcaggatggccagcgagtcacgcaccgatgcccacatggcgcggccttccacaatggcgtcgacgatggtctcgatgcggtcatcggtgaccacgaggtcggcggcctcgcgggcggcgggggttgcgcgctcgcccagcgcgatgccgatgtcggccaaccggatcgccggggcgtcgttggcgccgtccccggtcaccgcgaccacacggtcgttgcgttgcagggcgtcgacgatgcgcgccttctgcgccgggctgaccctcgcgaacaccgcgacggtggtcacttccgccgccagttggtcgccgtcgagggtgtccagttcggtgccggtcatgacgcgacgctcgttgagcgcgtcgagttcggcggcgatcgcctcggcggtgctggggtggtcgccggtgaccatcacgacctcgacacctgcctgctggagctgcgcgacggcggcggccgcagtgggccgcaccgggtcggccagcgcgacgaaaccgatcagccgcagatcccggatccgggactcgtcgagatcactgcggtccgaggcggcccgctccgcgacagccagcacccggtagccctgccgggcgaggttttcgacaactcgctcgacgcctcgacgagcggtctcctccaacggcacgtcgccatctgatctgcgccaccgggtgcactgggccagcacgatctccggggcacctttcacactcagcagattgccgtcgcgccaggtgccgagcaccgcgtggtagccacgggaaggctcgaagggcatctcgtcgatcggtacccagcgctgcttgccttcggccgggtgcactcccgcgccacgcgcgccatcgacgaccgcgcgatcggtgggatgcgggagcagttctccgttctccaccaacggacttgcccgcaaggcacccgcgagcactcgccgttccactgtggagatttcctcgagccaccggctcgacgcgccatcggatacctgccgcagcgcgatgcgcccttcggtgagggtgccggtcttgtcgaaacacaacacctgcgcccgccccaaagcctcgatcgtcgcggagttacgcaccagcgccccgcgtttcgacagccgccgggcggccgcgagttcggcgacggtggcaacgaacggcaatccctcgggaacggccgccaccgccaggctcaccgcccgccccagcgatgtccccaatggacgcctacgcagcatgtccgtgacgagcagaatcccacccgctcccacgcagatcggcaccgtcaccttggccagcgtctgcaggcgagccgcgacaccatcggcacctcgccgggcatcgggcccgatcgcgctgcctgcctcggtgttcgcgccggtcgcgaccacgacacccaccgcccgcccggcagcgaccgcggtcccccggtagatcatgcacgtccggtccgcgaccggcaccgccggagtcgccgtcaccgtcttggtgaccaacatcgactccccggtcaggctcgactcatcgacctccagcccgtcggcctccagaagccggcagtcggccggaacagcatccccggccaccaactccaccacatcgccgagcacgagctcgtcagccggcaactgcgtcacattttccttacggcgcaccacaacccgaacaacgctggcctccagaagcctgttcaaagcgcggtccgcggtgatgcgctgcacgccgccgatcaacgcgttcatccccagcacgcccatgatgatcgtcgcgtccgcaacggcaccgatactcgccgagatcgcggccccacccgccaacgccggcgtcaacgggctcgccagctcctccagcgacgcccgcaacacacccatccggcgaaggcccgtcccctcgtcctgaccttggaaacgctcgtgcgccgcatcatcggtcagaccctgcgatgaactgccgagcagctccagcaccatgccggggcccatcgcatgccaggcagtgcgcggcaccgcgcgcggaaccggacgccacgcggcctgcatcccccaccacgtcccagcgccgagcgcgattgccgcacacacggccaccggaacgcccgcacggacctggctcccgatggcaggcccgaacgcgccgaacaccgccccgctgaccgaaccgatcaacgacagctgcgcgctacgcacgctgacataacgcgcggtcgggaccgtactcaacaacgcacacgactcccccaggctcgcgcccgagatcaggtgcgcaccccacggaacctcaccaccacgcgtcacaccaagcccgacatccgcagccgccagtgccgcccgcgcccgcgcggacaccacaccgaccacgctgccctcccgctgcatctcccgcaccaccgaagccagccgcaccccacccgggaccacgcgatcaacaccgatccgccccgccaaccggcccccatcacccgcgagaaccaccgacccgacctcgcgagctgccgcgaccaactcctcagcgagcggatccagctcctcggcagccagaacccacgcggccgtgcgcgaatcgtggcgcagcgcgaacacctcgataccccgaccggccacctcgcgcacgtctgggggcaaccgcgaccgagcgaccgagtacagcgaccaaccatcacgctgcgcgccgacccccttggtcacacccacgagttcatgcgcacgttcccacaactcgacgaccgcgcgccccccgtccgcgggaatcacgtcatgcaccaaccgagcaccggtgcgcagaacgtccgcgtcgatcaccaccgtgtcgacccggtccaaccgccgcaacacccgggcatcgaacaccagagtcgtccgctccgacagcccgtacccgagctgcgccgcgaacgcgccccgccccacctgcgccgcgcgcggcgcgcccgcgaccaccatcgcctgcgcacgctgaaaactccgcgtcaccccgagcatgcccgcgaacgccgccggcccacccagagccgaaccgttcgcggcgcgctcgaccgggccggcgggcaacggcacaggacgcggccgaacccccaccggcgcactacggtgactggcaggatgcgcccccgttccggcttcccaccgcgcccagctccgccgcgccgcctgcgtctcccgcaacaggcagaaccggtaccccgattccgccagcaaactcgccggacgccgcgcaagcgtgttccccaacgcactgctaaacccgaacaacaggtcagtggcggtcttcccgatccgcgtttccagcggcccccggacccaggaggccgactcaccggtcgacaccagcgccggaacagacggcggcagcacgggcagcggcagcatccgggcccccaccgcgatcacagcgccggtcaagttcgcacccagcaccgtcgcctcagcgatcaccttgaccggattgtccgggtggctcacaccgaccgcagcgaacggttcctcgtccaaaccggtgtccgcctccgcgtcctccaccacacccaccagctcagcgaccccaaccaggcccggatcgtgcccgatgaccacccgccccacgacagcgttgatctcgacccacgcaacacccggcaccttctccaaccgccgggcgatctgctcgccagcctcctcagcccccggctggtcaacaccgcgcacctcgacgtacgcacgcccctccgacgaccacgcccgccgcccgcgccccaagcccgcgatgctctgcgcgacagccaccaccggcgccacgatctgcgaggccaacgcgcccaaggtacgcagcatcgaacacactcagctgtccgacgcaaagccgaccgacgcccgtgacacccccgcgccggtcgcccccgcaaccggccattcgagcccccaaccgacccgtaccgcgcgaaccgcgtcctcccaacgacccggcatgcgaacatcgacccgacgaaactgtgccacgacgggcaggctgaccgccgcggctcgcaaccgcgccccttgttgccgcgcgcctgcgccaggcgttgtgttccgcgccgtcctagccaccactacctcccgcgcgcacagataccgtgagtcacgagcgtaggaccgacgagcggaaagcgaacctcgaaacagccgcacatccgtcctctcggtggcctgcgagctgatcagcaacaccgacggcttcgccacgctgttcgacccgccgacacaccagtagtcccagcggtggtgaattcaaggccgcctgtgtgctcgggttcttcgaaacggctccgagcatgcagctacgccggacgcaggcaacgcaacacctacccaggttcacctggcctgagcgccgccgcggcgcgctcagcgacgcctagcccggaacccgctacaaaccggatcacttcgacgccggtccgccggcacgctgcgcgaccgcgacacccacgccaatcgccgccgccaccggccagtccatcaaccccaacagggtcagcgctccaagaccacgatagaaggccatcgtctgatggtccgggagaacgccccgaacggcctcagccgcgctagcaagatcatcacgagtgggaatgtagtgatcgggacggtggaactcggccgttacgcccggcagactcaccgtcgttcccccagcacccgccggtttccgctgcgtagtaaccacggcacctcctcaacacaggccccatgccgcataatcggcctcgcacggactcaaaaccgcccaaaccgaccaaccgggcaacacgattttatctctgaacacgaacgtccccgcgccgagacggctggaatacgggctgccgccggacctgaaccagtcaggcgttgtgcttcaacaacgttgctgtgcacccacctgctcgggttggccaaccgtgtggacgcaacgccggctccagtgactgctggtgatcacactcgttgatcatgatcgtctggactgcggtttgatcaaggcaatgttcccgcacctggccggggtgcgggagcggctggtgcgccggttcgcggagttcaccaacgagtatccgtggcggtggacaccgtcgcatgtggacgaatggtcgcaatcaccgaccggagaacggcatctcgcgccatccacaatccgcgcctaccaaggcagtctcaggctgttcaacgaattcctctgtgacagccggtatggctgggcgctggcgtgcgaggcgtcgttcgggccggacgagtacccggtggcgaatgtgcacgagtggaactcactcgcccatctccagtcctatgagggcgatccggacgaccgcccgttcacccgcgatgagctgcagcggttccttgactacgccacgaccaagtcgaccgcgcggttcgcgcgaaacgcaacggcgcattggcagcctatcgagacgcgaccttgttcaaagtgatgtatcgctagggcttgttcgccggggccctacccgcgtgcgctcccgcgattttttgagtttgtgcagttcagaggacgatgtgggagatgctagccgtcgcgacagatgtggtccaagtaggcgcggcaggcaaacctcagcggctcgcgtgcagtatgcggctcgcgcgcagtgcgcggggtggttcgccctcgaaacctgcggatccgtggaggtagccggcgatgaggtccggggcggagtggtcttcgatgccggtgaacccgagggcgtgaagctgtgcggcgatgtcgtcggttgtgaagtagctgaacaagggttcgccggcgccggccagccgatcggcacgtgcccgctggtgcgcacggtcctcgtcggtggccgcaggctgcaggtagtcgaagaccacctcgaccggctgggcttgaccagcgatgtattcgagggtggcgtgggcggcgttcgcggtcagatagaagacaacgccgagccacacgaatactgccgggtccgtccgtttgaatccggcggattccaatccagttgccagcggctgggtttcgaaatcgaccggtacgaaggtcaacgtctcagggcggtcgatccctgcgctagcaaggcgttcgcgtttccatgcttgggtggcggggtggtcgacctcgaagacgcgcaagtccgggcgcggattgcgataggcgaaggtgtccaggcccgcgccgaggatcacgacctgccgtacaccatcggcgatggccgcggccacggcgtcctcggcgaagcgggcacgggcggcgaagaacaggcggcggggctgatcgattgccccggcgccgaggtgatcggttgtgggcgtggccaatttggtcagttcctctgcggtgacgccgagcagacgtaccgccagggggtcggtgaagatctgtggtcggtcagcgatctggtgataggcgcgggcgtacgcggtagcgagcgctgtccggctgggtccgccgttctccatgttcaagaacttactcacgaacgcggcgcgggctctatgaactcactcacgcccgcttcacaaaggagcacgcgaacacgatccgtaaccacagctggccctcctttagggcgattgccacgagtcgacaggcagggctcgaaccctgttatcggggctgggttgatgtgttgagccgggtcatgagttcgcggttggtggccccggcgcggcaagatcgccggcgcgttcgtcgagttgctgttgctgcggcaagaaacgacagctcggccgaccgttcaacggtcacggtgcgttcggaccgcgtcctgccaccacacctgacggtctttgtcgtcaccgggccctccccattgatgtggccgctgatgctcgaatgcgcacgagtggtcagtcaacgccggttcccgcagcccgccttccccccggaagacggcgcgttcccgcacggcagccccacgcgttcacggggacgatcatcggtccacgaggcgaatacctgctccgtgcaggtggaagcggctattccaggggcccggccgtggttgctcgaatcggcgctcgcacgcggctgacggtgggcgcggcatgatgagcgaccgtgctgctgcgactggccttgcctatgccgataacctcgtccgtgcaggtcacacagcagcgtctgacggttttccggtcgagcccggccagccgggtcacctcacgcagcgaatggcgcgccagccacagctggcttggttctcagcggttgaacaccggtagctcggctggaggttgcgggatgaatccgccgtgctgggccatttggtcgtagagatgaccgtgcgactccgcgagcgttgcaagcgctccgttgacgtcgacgtgcaccagccggccgttccgcttgaccacccgcccatcgaccagcaccgtgtgcacgttgcccgagttggtctgcgcaatgatcgcgccacaagggtcgtggcggttccaaccggcctggctgatgcctgacatgtccagcaatacgatgtcggcccgcttgcccggtgccagggttcctgtcacgtcgtcgacgcccgcggcgcgggcaccgttgaccgtgagccaccgtaaggcgtcgcgcgttttccaccgcatgaccgtgggcagtgtcgaccgcgcgtagtcttcttgatcgtccctccatcgggtcacctgtaggacgagccgtgcgtgcgaaatcatgtcgccgcaggtactgctcgtgcagtcgatgccgaggcttggccccggcgtgttctcggtggcctcacgaatgaccgggaatcccatgcccatctgcatctcggtctcggcgcaaaccgagatcatggtgccggtaccccgcagcaggtgccattcgttctcagtgctgaatgtcccgtgcaccaagagaaggtcgctgccgagcatgttgtgggagtgcagcgcctcgatgtccttgaacaggttgcgcgcgatgacttggttgcagtggaacgtgatgcgtgcgccgagctcgcgggccagctcgaattcctgcttgacgtccccgaagggagcgatggctagttcctgcggggcgatgccgaagcgcagcaattgttgctcgctcgggaagtactgggcgcggatttcccgggccagccgcgcccgccgggcgaagtcgccttcttccaccgactcgtccagcccgcctttggtctcggaccacgtgttcgacgtgatgggcaggaggccgtggccgtacagcgcgcgcacgcccgcgtcgcggagtccagcgaccgcggcgtgcgcgtgctcgccggtgacgatgttgtggcagtaatcgaccagcgtggtcacccccgagttaaggcaatcgaggccaccgaggtagttgcccgcatacatgtcctgcgggcggtacttcgtcgccatctgcagccggaatcccctcaggtagtcgaggatgttcccgtccgccagaatgccccggagcccggtttgccaggtgtgtcgatgggtgtcgaccatgcccggcatggcgatcatcgacgaggcgtcgattcgctcggtgtcgccaacgttgaggttcggcccgatctcgacgatgacaccgttgtcgacgaggatgtcggctcgttcgaagtcgccgagaacgtcgtccatcgtcaccacggcagcgttctcgatcagtgtgcgcatggccaagtgctcctctccgcgcggtgggcatcggatgccgtcctcaagcggtcccgttcggtcgttgatcgactgtggagaagaggctgtggagaggggccgtctcgcagacggggcagcttctactggtccacgccaatccgaaaaccggcggttgtcagtcgcatcgtcgcgcggtcttctgttgaatgacccaggtcgcgatttgcgtccgagtggtgaagccgagtttggtcaggatgtgctcgacgtgggcctcagcggtgcggcgggagatcaccatgatggcggcgatttctttgttggtggtgccctgtgcgaccagcgctgctacctctcgctcgcgcggagtaagcaccgacgcgtgcgtttcttccgtcctggagcttgctggttccccggctttgcccggattccgtatccatgcgatggcctcgtcgaagtcgagctgtgtggcgtggtgaacgcctttctgaaacgtctcgtcgccgagtgagctacgtgctactgcctcgtagtggtcgtgtaggcgcgcaacatgtttgtggccggcgagcgacgcatcgacgttctttttgatcgtttgggacacgccgaacaaggtcgcagcccgtgccgggtcaccgtctgcgctggctatgcaggccagaatctcaacgcacaacgcgatctgaaactgctcatggaagccgagccgcaggcgaagactctccagttccgcagcattggcttgccggtaattgcccgctagtaggtctgctattcccttcgcccacagggcaagcgatctcatccactgttcgctgtaggtctccttgacggcagggcacccgcggaacagggcagcggcgcgctcatgatcaccaaggaacgcgactgccaacgcgagctcgatctgatcgtaggcggcggcagcgtgatcgccaatcagccgatgcttggcgagagcgtcttcgaagagcgcgctcgcccgcgccggatcttcgttgaacagggcggtgagccccgagatctgcgcgacgtaggccgcccctgattggtcgcccaactccgccgccagcgcgctcgcctgctcgagaagggctgacccggatgacgcgtcgttgagcgcggcattcaggtacccgtcgacgtagagagctttgacacgtaccggatccgcatcgaatcgatggtaaccggacatatgcggctaatggtgcacaacgggcagtgttgatctgaccacgctaaccggtatctcgggcgggtcgcgtgctgcgccgttcaagctcaagcgtgcggtgcgtcttccgctcgacgatctacaagtacgtccccgaactcagcacccaccgagcgctcgcctctgggcccggtccgcagccagcgttccagagctaagcgctggtttccggcgtctgctaccgggacgcttcggccgccgtgggttcagcgcaagtgagggttcctcggcgggaacccaagggtccgtcccgcccaggaccaggactggacccgtgggttcggctcaacccggagtgtcgcatttgatcgtggtttccagcagtaatggatgctgaatcttgtgattgacgccgccgcgaccggagagtgtcttggagcaaccgattcccgcgcgattccggaccatccatcggacctaggttctgttgcgacctgagcccgccggcgcggcggagtttccgcctcaagtggccaggtccagccattcctcgatgggcagcacgtgtgcgcggtgtccggcgtgcgtgcggaactcattctccgggtcggagacctcgacgtagcccgcgatcttgtccggctgttccgcctcgtagtgcatcggcactgcgtaccgggcgtcgaggatctctgcggctgcggcggcctgcctcgggtccatcgcggcgggcagcgggctcggcggctggaggtgtggcgcgtcgaccaccgcgccgttggcgggcaggaacaccgcgtcgaacgggctgaaccggcgcgcgatgagccaccagtagccgtggaacatcgtgtcgccgccgtggaagacccgctgcccgtcggcctgcaccacccagttcagctgcgggtcgcccagcccgtcgacggcggggaccgcggtgacgcggaacggcccgaggtcgcgggtggaccaggcatccacgacctcggcagccagtcggtgcagtgtcagctcgcgctcggccggcagtgtcgtcacgttgtccacgtcgtcgccgtggccgggcgcgggtcggagcaccggtgcccccggtgtcagcgcggccgcgagcgcggccgcgtcggtgtggtcccggtgcaggtgggtgaccagtgcggcggtgaccgtcccgctcggcaccgccagcctctcgccgggtttccacgccgtgaacagcggtgagaggtcccgtacgtagtcgatcaccagtcgcttgccgcccgcctcgatttccagtccggcccagcccagtcgtcgcacccgcatctcgcactccttcggtccgtgggtgaagcggaatttagcgtacgcacgttcactaaatcaatagcgaacgcgcgtacgctatcctcgtcacatgtcaccgcgacgctcagcggccgaagcacaggccaccaggagccggatcctcgaccgtgccgccgagatcgcatccgaggaagggctggacggcatcaccatcggccggctcgccgaggaactggagatgagcaagtccggggtgcacaagcacttcggcaccaaggagacactgcagatctccacgctggacaaggcattcgtggacttctggcaccgggtggtcgagcccgcactggccgagccgccgggtctgcggcggctgcgcgcggtgtgcgccaacgccgtgggctacctagaagcgccactgctgcccggcggctgcctgatgaccgcggcgctcaccgagtacgacggccgccccggccgggtccgcgacgcggtggccgaggtgtggtcgcgctggcggggacagctgcgggcggacctgaccgcggcggtggagaacggcgagctgcccgccgggttcgacatcgaccaggcgctgttcgagatcgtcgccaccgggctggcactgaacgcggccatgcagctccagcacgaccgggcggccgccggccgggcccgccgcgcgatcgaacgggccttggaccagtcctgacgcccgcgccagacaaacccgcccgattctttcccgaggaccagaccgtctgaccgcgttcctgctggtcagcccgtatccatcccatttttcggcgagtacgccctagcatggtcacgagacattcccggagccgtcattgattgactggcgcagcgaaaagctactcgccggttgctttgcaccttgggtcagcttcgggagttccgggcccagagtcccgtgggttcagtgtgagtgaaggttcctcgctgggagcccgagggggactgccaccagggtctgaagacttcgtgaagaaggtatgaacccgggttgggcatgcttcgttatgagggtatgggaagccaaggcttgggagcgtggacatcatggcaaacgatcacggcacggtgctcgccaccatgatcttcaacctggtagccccggcgggtgtgatcgcgccagtcggcgtggagctgcggtacgacagccgcaatccgtacgagatctccatgaagctcaacgtaggcacggacggtcaggtggactgggtgatcgcccgcgacctgctggccgacgggctgatcgccgaggcaggcgaaggcgatgtgcggatcggccctcgacggggttttccggggttggtcgtgatcgagatgagctcgccgtcggggcaggcctccttcgaggtgaatgctgaccagcttgcggacttcttgaacgacacctacgacgtggtcgaacctggtgatgaacaccggtggatgaacgtcgacgaggtgctgagccagctgctctcgcacaacctgtaatggcccagctctcccgaagcgccgcacgccaaagcgctggctgcgggacctggcggcgctgaacaccgccacgctgtgtctccgagctccagctggaccacgtcggtgccgtgcgcccggctcggtcaggccgaaggtgctgatcttctccaggcgcgccatcggcgcaggaagcgctgcttctgctcccgccgcagtaccgtcgtgtcatggccacggacagcttcgattcctcgaagctacaggcggccgtggcatcgagcgtcgcgtcgtgcgtctcggaagtcagccgagacgtctacacgcacctgattaccgaggctccgcagttgcgagccgatgagatcgtcctcagcattctacggacgagtgttgaggaaaatatcgccacattgccgcacgttctcgaattcgagattccgttgggatattcgccgggtcctgctgcggtgttggagtatccgcgacgactggcgaaacatttccatcaacgcgctgatcagggccaaccgcatcgggcacttccgcttcctgtagtgatgcctcgacgagatccgccgccaatgcgccgacgaggccgtatccgcagcgaccacgcaacgaatgctcgcaaccagcttcggctacatcgaccgcgtcacggagcagatcgccgaaacctaccagctcgaacgggaccgctggctcctggcgacgggacggccgtgaggtctctgcggcatccgcatagcgtcttctcccgctgaggcacatgaggtgttgcgcgcggtcgtttccggcagtcgcacggcattcgtcctagctgcgggcaattgagggagcgaagatttagaggagtgtggccacgcggaccaagccggcgagtgctcgggagcggctgtggggcggccaggcgatgactgtcgtcacgtccggcgcgtctagaaccggtacggcggcgaggccttcgagcaggttgacgcgactggattcgggcatgaccacggtagtgcggccgagtgcgatcatttggaacagttgcgtctggttgcgtacttccacgccggggccatctggatagacgccgtcggggccgggccagcgcgcaagcgggagatccggcagtgagctgacatccgccatccgtacatggggctcgctggcaagcggatgcgaggtcggaagaatggcgacttgttgctcggtgttcagaatttcgatgtcgagttcggccgtcgggtcgaagggttgatgcaacagcgccacgtcggcccggccgtcatgcagcgttttctggggctgggattcgcagagcagcaggtcgacggccacggctcccggctcggcggcgtacgcgtcgagcaacttcgccagcagctcaccggaggcgccggccttggcagccaggactagcgagggctggctcgtcgcggcacgctgggtgcgtcgctcggctgctgccagcgcgccgaggatcgcccggccttcggtcagcagcattgccccggcttcggtgagcgagactttgcggctggtgcgttgcagcaacacgactccgagtcgttgctcgagctgggcgatcgtccgcgacagcggcggctgggcgatgcccaggcgctgggcggcccggccgaagtgcaactcctcggcgactgcaacgaagtaccgcaactcccgcgtctccatccgtcgagcctaccgctgattcatatcagctgggtatcggtgtgagacctagatggtgttggttccccgccggtttcgggccacgctagaaagcatgagcgaacagacgattgcactggtcaccggcgcaaacaagggaatcggatacgagatcgcggccgggctcggcgcgctggggtggagcgtcggaatcggggcacgggaccaccagcgcggggaggatgccgtggcgaaattgcgtgcggacggcgtcgatgcgttcgcggtatccctggacgtgacagacgacgcgagcgtcgcggctgctgcggctctgctcgaggagcgcgccggccggctcgatgtgctggttaataacgccggcatcgccggggcatggccggaggagccctcgaccgtcacaccggcgagcctccgggcggtggtggagaccaacgtgatcggcgtcgttcgggttaccaacgctatgctgccgttgctacgccgctccgagcgcccgcggatcgtcaaccagtccagccacgtcgcttccctgaccttgcaaaccacgccgggcgtcgacctcggcgggatcagcggagcctactcaccgtcgaagacgttcctcaacgcgatcaccatccagtacgccaaggaactcagcgataccaacatcaaaatcaacaacgcctgccccggctacgtcgcgaccgaccttaacggcttccacggaaccagcacgccggcagacggtgccaggatcgccattcggctcgccacgctgccagacgacggcccgaccggaggcatgttcgacgacgccgggaatgtgccctggtgaggcgctcagtcggcgatggtgcaatcgaagtcggagaggctcgctgcgaccgggtacgccgaacaacacctgttcctgtgggtacggatgtcggccttcgccgtctcggtcattgacaacctgtacttcgggcgccgttaccgccggtgcgccgcggttgcctggcgacactgggccagccgtggctcaccggcggcttaggtcaggcgtgggcggttgccagcatggcgggtgcggctttgcgtaggtcgggtaggcgcatccggcgcgggagccggtcgagttcttcgccgatggccggtgctttggggctgctcaggagccgaacacctcccagccgcaggtgccgggctgaaccgagtggttctcgtcggctcggatcacaacgtctgccggaacagctgcggcgaggtggtcgcagattcgaggcgggatcgtcctcggcgaccttgccgacgatcgcggctagggcccagggcttcgtcgacctggttggcacctagatcacgacggtcaaaacttgccggcatcagagacgatcgaagtgatcccgggtcacgtcggcttatcggtcgagtgagtcccggggcctgcccagccaggtcttgcgtcgttgttccgggctcagttgcggattccgacgaacaggcctcggccgttcggtgctccaggaaggtattccgcgcggatccctgcgtcttcgagcgcggcggtgtactcgtcctcagtgaacagcgagaggatttcgaactctgtgaagtcccggatcccggtgggttcggcgactgtgtagcggacggtcatccggctcgtacggccctccaggaccgagtgcgatagccggctgatcacccgctcgccgtggtgcgcgacggctccggtgacgaacccgtcgatgaacttgtcgggaaaccaccagggttcgatgaccgcgactccaccaggggccaggtgccgggccatgttccgcgtcacgcgtcgcaggtcgtcaacggtccgcatgtaagccgcggtaaagcacaggcaggtgatgacgtcgaatggctcgccgaggtcgaaatcgcggatgtcaccgatgtgaatcggtacctcagggactcgtctgatcgcgatctcccgcatcgcatcggacagttcaagccccgcgaccttcgcgtattcggcacggaatcgctctaggtgcgccccggtcccacaggcgacgtcgagtagggactgtgcttcgggcagcctggtgcgtacgagctggactacttccccggcctcggctgcccagtcccggccacgcgcggagtggatcgcgtcgtagatgtcggcatgatctgggctgtataccgaggaggtttctgcgaatgtgtcgctcacgcgcgacatcctcactttcggagtggtgatctttggctgatgtggtgttcgacggccttctggaactcgtcagccaccgtgcgcacctcggcgtcgtcaaggcttgggtgcagtggtagcaggagtgttctgcggcaggcgtgctccgcagaaggcagcttgcagtccgcgcggtagatggggaccttgtgcaggggcgggtagcggtagctcgtgtagatgccgcgttccagcatttgctgcgccacctggtcgcggatctccggagccagctggacccagtagaagtagtgtgacgagacgtgcccatccggtagcgtcggcggtaggaggacacccggcacatcggaaagcaaccggtcgtactgcgtagcgatttctctacgcctgttgatgaattctggcagtttgcgcagctgcacgctgccaagcgctgccgtcatgtcgttcccgatcagccgctggccgatgtcttcgacgcgaatatcccaccagcggttggaagacttggccgaatcgaatccgctcatctgctcaagaccgtggtaggcgagtcgtcttgcgcggtgcgccagctccggatccgccgcgtagaacatgcccccatccccggtgaccaggatcttcatcgcatcgaaactccacgtggccaggtcaccaaaggttccgcaagcggtgccgtgcacggacgatgccaccgcgcaggcggagtcctcgatgagcatgaggcccttttcacggcagaaatcggcgatcgcggtgacttctcccggcgatcctccatagtggagcagcaatacggccttggtcgccggcgtgatggccctcgccacatcatccagcgtggggttcaacgtccgggggtcgacgtcgcagaacaccgggcgggcaccggaggatgcgatggcgttggccgccgccacgaagcttatcgaaggaagtaccacgtcgtcgcctgggccgaggtcgagcacctgcacggtaaggaacagcgcggcagtccccgagttgaggaacacgacctgttcgggatccactcccaggtggtgggcgaattcggcctcgaacgtccgggtgcgcggcccgagcccgatccagttggaggcgaacacctccgcgatcgcgtcgagttcttcggtgccgaggatcggctggtgcaggttgatcacgttgctgaaatcctccgagatgccgccatgctggatgctaggaactcttggccacgaattcagcgattgattcgacgacgtagtcgatcatttggtccgttatgcctgggtagacgccgacccagaaggttcggtcggtgacgatgtcgctgttggtgagcgcgtcggcgatccggtaccgcacctgctcgaaggccgggtgccgggtgatgttaccgccgaacagcagtcgggtgccgatgttgcgggattccaggaagttcaccagggcggcacgggtgaacccggcgtccgcactgatggtgatcgcaaacccgaaccagctcgggtcgctgtgcggtgtggctaccggcagcagcaggcccggcaacccggacagcccttcgcgcaaccgtcgccagttacggcggcgtgccgacccgaatgcggaaatcttgctcaactggctcagcgcaagtgcggcctgcaggtcggtggtcttgaggttgtaaccgacgtgggagaacgtgtacttgtggtcgtagcccggtggaagggtaccgaggtggtagtcgaacctcttgcggcaggtgttgtccacgccgggctcgcaccagcaatcccgtccccagtcacgcagcgactcgatgatgcgagccaattccaggctgccggtcaacacgcagccaccctcgccgctggtgatgtgatgggcaggatagaagctgaccgttgtcaggtcgccgaaggttccggtcagccgtccccggtaggtggatcccaccgcatcacagttgtcttcgacgaggaacagctcgtgttcttttgcgatctccgcgatttcgtcagcggcgaaggggttgcccagggtgtgcgccagcatgatggctcgcgtccgttccgtgacggcggccttgatgcggtctggcgttgcgttgtaggtgcccagttccacgtcgacgaataccgggacgagtccgttttggaccgccggattgatcgtcgtggggaagccgaccgccgcagtgatcacttcgtcgccgggccgcagtcgtgcctcgccgagtttgggggaggtaagcgaactcagtgccaggagattggccgacgaaccggagttgacgagatgagccttgcggaggccgaagaagcgggcgaactcgctctcgaatcgccgtgcattcccgcccgcggcgatccggagctccagcgcggcttccaccagtgccacccggtcgtcctcgtcgagcacggcgcccgatggccggatcggcgtcgatccagccacgaaggtcggggattcctgttcgcggtggtaatcgcgtacggatgccaatatccggtccttggcatccggcaccatctcagtagcggtagcgcaagtgtcgtcacacgaagtcactctggcgcgccctttccccagcgctctggttttccggctctgcatgcaggcgacgatcagtcttcgcgccttgccttcaggagatgagcgatgcccgtggcgaatcgcgttatgacgtcccagcgggacagtgtgctgtctcggcgccttacaccttcctgccctggttcgatgcggtgcgggacatcaggacagcggagcaaggagaagcgctcattgactcagaaatcctcgatctacccggcacacccgactcggtagagcccaggctagcgggaacgacctgctcgcgcttgtcaagatcgctaccatcacctggaaggcctaagatttggcttgcgaaagcggcgtttcccgggggatatcagagatttctgtgattcttggcatgcttcccgggtgttcaattgcgatcggagagttcatgcgtgtcctgttcaccccgctgccggcgagttcgcacttcttcaacctggtgccgttggcgtgggcgttgcgtgccgcggggcacgaggtccgtgtcgccatctgcccgaatatggtgtcgatggtcaccggagcaggactcaccgcggttcccgtcggcgacgagctcgacctcatctccttggcggccaagaacgaactcgttctcggcagcggggtctcgttcgacgagaaggggcggcatccggaactcttcgacgagctgctgtcaatcaactccggcagagacacggacgccgtggagcaactccaccttgtggatgaccgatcgctggacgatctcatggggttcgccgagaaatggcagcctgatctcgttgtgtgggacgctatggtgtgttcggggccagttgtggcgcgagcgctcggcgcacgacacgtgcggatgctcgtcgccctcgatgtgtcggggtggctgcggtccggtttcctcgaataccaggaatcgaagccgcctgagcagcgcgtcgacccgctcgggacgtggctgggagcgaagctcgccaagttcggagccacgttcgatgaagagatcgtgacgggccaagcgaccatagatccgattccatcctggatgcgcctgcctgtggacttggactacatctcgatgcgtttcgtgccgtacaacggtccggcggtgttgccggagtggttgcgcgaacgaccgacgaagccgcgcgtctgcatcacgcgcgggctgaccaagcggcggctgagcagggtgaccgaacagtacggggagcaaagtgaccaggaacaagcaatggtggaaaggttgttgcgcggcgcggccaggctcgacgtcgaggtgatcgccaccttgtctgacgacgaagtacgggagatgggggagttgccctcgaacgtccgggtccacgaatacgtaccgctcaacgaactgctggagtcgtgttcagtgatcatccatcatggctcgacgacgacgcaggaaaccgccacggtcaacggcgtaccgcagttgattctccctgggaccttctgggacgaatctcgtagggcggagctcctagccgatcggggagccggtctggtcctcgaccccgcgacgtttaccgaagacgacgtgcgaggtcagctggcccgcctgctcgacgagccgtcgttcgctgccaacgcggcgctgatccgccgtgaaatcgaggaaagtcccagcccgcacgacatcgttccacgtctggaaaagctagttgccgaacgtgagaaccgccgcactgggcagtctgatggccatccgtgagcaacgtgtggccggaaacatggacgccggggtttggcaggtgttcatcgctgttgcgtcgactcggattccgccgtgaccgggacgatgccaggcgagtcccgaagtcagattcttgtccagaatcgtccaatggggtgttgatctccccagaggtttgcgctccaaccgatttccgacgaggatcgtggcgcccgctgagcaacgactaccgtgcggtcgagacataccgctgtgcgccaggagcgaaggtgggttgcccgatcaccgtgctggtggtagatgccgagccgaaggtcaccttggatgaggcggaagcctggcgagagcacaccgaggccgtggccgacgtccgtgtcttctccggcgggcatttcttcatgaccgaacgccaggacgaggtgctcgcggtccttacgggcggatcgcttcgatgatcctcgccaggccgctggaccagaccgcgacgcccctgggagccggcgtgcacatcgtcacggcagtgagggattgggcatgagcagttctgtcgaagctgaggcaagtgctgctgcgccgctcggcagcaacaacacgcggcggttcgtcgactctgcgctgagcgcttgcaatggcatgattccgaccacggagttccactgctggctcgccgatcggctgggcgagaacagcttcgagaccaatcgcatcccgttcgaccgcctgtcgaaatggaaattcgatgccagcacggagaacctggttcatgccgacggtaggttcttcacggtagaaggcctgcaggtcgagaccaactatggcgcggcacccagctggcaccagccgatcatcaaccaggctgaagtaggtatcctcggcattctcgtcaaggagatcgacggcgtgctgcactgcctcatgtcagcaaagatggaaccgggcaacgtcaacgtcctgcagctctcgccgacggttcaggcaactcggagcaactacacgcaggcacaccgtggcagcgttccgccctatgtggactacttcctcgggcggggccgcggccgcgtgctggtagacgtgctccagtctgaacaggggtcctggttctaccggaagcgcaaccggaacatggtggtggaagtccaggaggaagtgccagtcctgccagacttctgctggttgacgctcggccaggtgctggctctccttcgtcaggacaacatcgtcaacatggacacccggacggtgctgtcttgcatcccgttccacgattccgccaccggacccgaactagccgcctcggaggagcccttccgacaggcggtggccaggtcgctctcgcacggcatcgattcgtcgagtatctccgaggcggtcggttggttcgaggaagccaaggcccgctaccgcttgcgggcaacgcgcgttccgctgagcagggtcgacaagtggtatcgcaccgataccgagatcgcccaccaggacggcaagtacttcgcggtgatcgcggtgtcggtgtccgcgaccaatcgtgaggtcgccagctggacgcagccgatgatcgaaccgcgagaacaaggtgagatcgcactgttggtcaagcggatcggcggagtgctgcacggtttggtccacgctcgggtggaggctgggtataagtggactgcggaaatcgctcccacggtccagtgcagtgtggccaactaccaaagcaccccgtcgaacgactggccgccgttcttggacgacgtgctcaccgccgatcccgaaaccgtgcggtacgaatcgatcctgtccgaagaaggcggtcggttctaccaggcgcagaacaggtaccggatcatcgaggtgcatgaggacttcgcggcacgacctcccagcgacttccggtggatgactttgggacagttgggcgagctgctccggagcacccacttcttgaacatccaggcgcgcagcttggtcgcctccctgcatagcttgtgggcgttggggcgatgaccagctcgatgcgaaagccggtgcgcatcggtgtgctcgggtgcgcttccttcgcgtggcgacggatgctgcccgcgatgtgcgacgtggccgaaacagaggtggtggcggtggcgagccgtgatccggcgaaagccgaacggttcgcagcgcgattcgaatgcgaggcggtgctgggttaccagcggctcctggagcggccggacatcgatgccgtctacgtgccgttgccgcctggcatgcatgcagagtggatcggcaaggcgcttgaggcagacaaacacgtgcttgcggagaaaccgctgacgacgacggcgtccgacaccgctcgcctggtcgggctggccaggaggaagaacctgctgctgcgggagaattacctgttcctccaccacggccggcacgacgtggtccgcgacctgctgcaatccggggagatcggtgagctccgggagttcaccgccgtgttcggaattccgccgcttcccgacacggacatccgctatcgcaccgaactcggtggcggagcgttgctggacatcggtgtctatcccgcccgtgccgctcggcactttctcctcggtccgctcacggttctcggcgcaagctcgcacgaggcccaggagtcgggcgtcgacttgtcgggcagcgtgctgctccaatcggaaggtggcaccgttgcccacctcggatacggtttcgtgcaccactaccgcagcgcgtacgagctgtgggggagtcgtgggcgaatcgtcgtcgaccgggcgttcacgccgcccgccgagtggcaggccgtgatccgaatcgagcggaagggcgttgtcgacgagttgtccttgccagcggaagatcaggttcgcaaggcggtcaccgccttcgcacgcgacatcagagcagggacaggcgtggacgaccctgcggtggccggagattcgggcgaatcgatgatccagcaggccgcgctggtggaggcgatcggtcaggcccgtcggtgcgggtccacatagccgcccggcatccgcgggtagtagttcgcctcgaagcctgaccgggcatccggaagccagcggggaagccgctggagaggctcaccgccatccgctcacctggcatctcgcggaccgctgatcgcggacggctcggagaagtgctcgtcgaaccacgagacgaccactcgcgagctggccagggcggcgggaaagtgagccaatccggagagcggatgccaccgcactggcgtacccgccgcgcggtagctgtcccggagtcgctcgccgaatgcgaacggaacgatctcgtcgtccgtgctgtggtagacgagcgtggggaccaccgggccaccgttcctacctgcgacgctttcggccagtcgtgcgcgccatcgaggttgctcgaaaaggccggaagtgtcgaggaagtcgctcagctcgcggccgaggaagcgggtgacgagctccggtgcaccgagctcgcgcacttgatcaacggcggtacgacccgcttcggtgagaagctcgtcgaatggcagatcggggtaggcagcggcatgcccgaccaggccggccagcaccggcccggtgaacaccccgtcatttcggtggatgatgtccagcagatcgatcggcaccgcacctgcggccgcagcgcggattcgcagttcaggtgcgtaggtggggtgcagttcgccggcgaaggccgacgcttgcccaccctgcgcatagccccagatgccgaccgggcagtcggtcgtcaggccggagcccggtagccgttgcgcagcgcgggcggcatcgagcatggcgtgtccctgcgccctgccgacggtgtaggtgtgggttccaggagtaccgaggccttcgtagtcggtgatgaccacggcccacccgcggtcgagggccacggcgatcagctcggtctccggctcggttccggttcgaagcaggtacgacggggcaacttggctaccgaggccgtgggtgcccactgcgaaagtgatgatggggcgatcttcgcgcggccacgggatgttcggcaccagaacggtgccggagacggcgttcggcatgccaagggcggagttggaccggtagaggatttgccaggccttggctgcgacgggttcgcccgtgccgcgcagtgccgagacgggccgggccctgaggagcgtgcccgggacacccggcggtagcggcgtcggcggtcggtagaagggatcatccgcgggtgcccgcagatcgtcgccgaccaggctggcgtgctcggaggccatcaggactgcttctttcgagcctgcaggagcatgaaacccatgctttcctcgtttctggcgtaatccggatgtttccggtattccgcaaccgcggcgatcagctgtgctggtcccggtccgtgcttcgccgcgatgtctcccaagtagcgttgctggtaggtgccgacagccgcaggctcgacgccggcgagctcatcgagtttccggagcaactcgtcgacgtaccaggagaccatgcacctggtctgtgccgtgaggtcggtgacttcgagaatctcgaacccggcttcgctgaccagcgccgtgaagctgttcaaggtatgggcggtcgtgcccgtccaaaccgccgcgtactcttccgggagtcgaacccgagtgatgatgtctccgaggacgaaccggccgccgggttccaggattcggtggacctcgcggatcgcggcggcctggtccacgatctgcacgacggactgcatcgcccatgcggcctgaaagaaaccgtccgggtagggcagctgggcgccgtcgactagatcgaactcaagactgccggccagtccggtctcgttggcgagcctggtggcggcggcgagatgctgggcgttcacggtgattccggtgactcgaacgccgctggcgcatgccgcacggactacgggctgcccattgccgcagcccaggtcgaacaggtgcgctccgggacggagcgcggccttgtcgatgaacaggtcggtcagttggtcggcagcatccgaccacggtgtggcaccggcatcctcccgatacccgcccgcccagtaaccgtggtgcaggggacgcccgtgcgccaacgcatcgaagatggactccacctgatccgcggtcggaaatgcctgtgtgttcgcccctctgctgttcactcgtcctccgcgctgttcacgtcggccaggtgcaatatgtcgtccagactccttggcacccaagcaggaacgccgccttcggcgttgacgcctttctccaggaacgcgatgttgtggtaggtgtggaggccgaccaaattgcgttccaggtagctcggctcgtacgagcccgcatgcggctgctcctcgtgctgaacgccttccaacaggttcttgagcaggctgaccgtggtgccgggtgcggccgggcactgcgcctgcccgccgaatccgggagcataggtcgtccacagatcctcgatcacgtatacgccaccgctgcgcaaccgggggaacagcgtttccagggatgtgcgcacgtgtccgttgatgtggctgccatcgtcgatgatgatgtcgaacggtccgtacttgtcgtcaacggcggccagctcctcgggcttgctctggtcggcgcggacggtgcagagcctctgctggtcgaggaaggacttgtcgaaaacgtccatcccgaacacgaggccgcggtggaagtagcgcttccacatcttcagggattcgccgccgccaccgtcgaagttgtagccaccgacaccgatctccaggatgcgcaccgggcgatcacggaactcgccgaggtgtcgctcgtatagcggggtgaaccagtgcaggccgccccacttgtccgtgcggtagtgggaggcgagcaagttgaggtcgggacgtcggtgcccgcagccggcgaccactgcggagatggcctggaagccatcggacagttccgacggaccgggtatcgaaccggatgtggtggttcggaggaagttggtgctccgggcgccgacggccctgggagctcctgggccgaacaactcggcgatgagatcggtgagctcgtaaccgatccgcagcgggacgtctccgaccggtcgttgctcggccttgatcagctcaccggactgtagcgtcaggacgaagtcaacggtctcgcctcggtgggtgatctggaccgcgacctcggtccgttcgatgtcgggggccggttccgcgcggaagaggatctcgtcgatcagcacgggtgcgatcctggcgagtccgagttcggtggtcaggtcggccaggctcgccgcactggatccggcggcgaggatgatgcgttccacggtttcgatctcgtgcgttgtggacatcgtgatgagctcctcatggctgaccgggtgaaagccgtgccggcggtttgatcgacaggccgtgctggaagatgttctgcggatcccaccgcgctttggcccgctgcagccgcgggtagttgtctttgtagtacaggtcgtgccaggcaacaccggaggtgttccacaatggatcggccaagtcggtgtccgggtagttgatgtaggagccgtcgacacgggtacctggcaccggaactccgccggtttcggcgtacatctcgcggtagaaaccgcgaatccaggtcagatgccgctcgtcctcggcgggctccgaccagttcgtgacgaacagcgctttgagaaccgagtcgcgctgagcgagtgcggtggccgacggagccacggcattcgccataccgccgtaaccgagcagcaacagcgccgccgcagggttgtcgtatccgtagacggtcagccgccggtaaaccgtggctagttgagcttcggacagcccggtgcgcaagtaggcggctttgaccttggtccgttgcatgcccggttcgccgccttcggcgatcgccccggccacctgggtcgatcgcaaccacggcagggtttcccgcagcccttcggctggagtcacgccgacctgggcgttgatcgccgacaggtgttcggccagggtgcgttccgcgttcggatccgtgccgtccaggtgaacgttcagcgtgacgtagccagcttgccggtgtgcgcagacgagcgtgctgaacaacccgagttgcgtggattcaggcgcgctgtgctgctcgtaccaattgccgaagttctgtaggagcacggcgaatgactgctctgtcagttcgtgccacggccagtggaacgatcggagcagcactgtcgcgggcggccgtggcaggagctctgcggcgtcggtgctgaccacgtccggcgttcggagccaaaacctggtgacgatcccgaagttgccgccaccgccaccggtgtgcgcccaccacaagtcgtgaccggcgcccgtggagttccggtcggcctcgacgatgtgcacttcaccggcctggtcgaccacgacgacctcgacgccttgaaggtagtcgacgaccgaaccgaatcggcgcgacagcgggccgtatcccccgccgaggatgtgcccgcctgcgcccaccccgggacatgcgccggtcgggatcgtcacgccccagttcttgaacagggttcggtacacctgcccgagggcggcgcccgcctcgatcgcgaatgccccgcgcgtgctgtcgtagtacacgcggttgagctcggagaggtcgacgagcactcggatcgccgggtccgcaacgagattctcgaagcagtgcccgccgctgcggacccctacccgcctgccggtgcgcacggcgtcggcgacggcgtgcacgacgtcttcggcggagctggcgatgtggatgcgttcgggttttccggtgaaacgggggttgtgcccgacgacgaggtccggataacgaggatcgtcgggctcgacggtgatctctgttcctggggttcgacgattcatgggtgccgggtcatggaattcgggcaccgcccctccttttctgactggtccactttgttcgcccgcagccgagatcatctacgcgtccgggtgattatctgtgtgtttcagctcatacgtgaaacccggtcgcctccgccggctctactttgtggatcgatatcgcggtgcgcatggtgccgtatgcgctggaaccgaaaaggtgatgactttccatgagtgagatcgcagttgccccctggtcggtggtggagcgtttgctgctcgcggcgggtgcgggcccggcgaagctccaggaagcagtgcaggtggccggactggacgcggtggccgacgccatcgtcgacgaactcgtcgtacgctgcgatccgctgtcgttggacgagtcggtgcgaatcggcctggagatcacttctggcgctcagctggtccggagaaccgttgagctcgatcacgcaggcctgcggctcgcggcggtcgccgaagcagctgctgttctccggttcgacgcggtggatctgctggaagggctcttcggcccggttgacggcaggcggcacaacagccgtgaagtccgctggtcggacagcatgacgcagttctcgcccgaccagggcctcgccggcgcgcagcgcctgctggcgttccggaacagggtgtccaccgcggtgcacgccgtgctggccgcagccgccaccaggcgcgcggacctcggtgcgctggcagtccgctacggatccgacaaatgggcggacctgcactggtacaccgaacactacgagcaccacttctcccgattccaggatgccccggtgcgagtgttggaaataggaatcggtggttatcacgcacccgaactcggtggtgcttcgctgcgcatgtggcagcggtacttccggcgaggtctcgtttacgggctggacattttcgagaaagccgggaacgaagggcaccgagtgcgaaagctgcgaggtgaccagagcgatgcggaattcctggaagacatggcggggaagatcgggccgttcgacattgtcatcgacgacggcagccatgtcaacgaccacgtcaagaaatccttccaatccctgtttccgcacgtccgcccaggtggtttgtacgtcatcgaggatctccagacggcgtactggcccggctacggcggtcgcgatggggaacccgcggcccagcgcacctcgatcgacatgctcaaagaactgatcgacggcctgcattatcaggagcgcgaatcgcggtgcgggaccgagccctcctacacggaacggaacgtggcggccctgcacttctaccacaacctggtattcgtggagaaagggctcaacgctgagcctgccgcgccggggttcgtgccccggcaagcgctcggcgtcgaggacggctgagccgttcaccagctgcggcgccagtaggcgcccgtgccgtcgatgtcgtggatgggttccgtgatcccgagttccgcgcggaaccccttcaccgcgtcctggcaggacggcagaaaatagtcgtcgatgatgacgaatccgcccggcgagagcttcgggtacaggttccgcaatgagtccattgtggattcgtagaggtcgccgtcgagtcgtagcacggcgagttcctggatgggggcggtgggcaaggtgtcccggaaccagccggggaggaacctgacctgttcgtcgagcagcccgtagcgggcgaagttctgccggacggtctcaagcgatacgccaagcacgtcgttgtactcgtgcagcgccatagcctggtccgcttggtggtcttgcgcagagctttccggcattccctggaaggaatccactacccagacggtacgtccggtatctccgaatgcctggagaaccgcgcgcatgaagatgcatgcgccgccccgccagacaccggtctcggcgaaatccccgggaacaccgtctgcgagcacggcttccacgcagtgctggaggttgtccagccgctccagaccgatcatcgtgtgcgcgacagttggccagtccgtgcctttggcccgagcggcctgcctgtagtcggtgttgtcctgccaggcgttcggatgcggccgatcactgtaaatcgtgttggtgagtaccttcttgagcaggtccaggtacagcgcgttctgggagggcatcggttctccggatccagctgttctcgggtgactagttcatcaggcacggatggccgcagtgttctccagcgtccgcaccagcgcggcgggatggggcatggccgtgatctcgtcgctgagtttgattgccgcagcagcgaagccggtgtcgccgagcaccgttgcgattgagtcggtgaactgttcgtggtcggactgggcctgctcatccggcaagcagatgcccgccccggcagcggcgaggttgcgcgcgtagtcgaactggtcgaagtactggggaagcacgagttgcgggatgccgagtcgggtcgcggtgaatgccgttcccgagccgcccgcgcagatgaccagctcgcaggtacgcaggaacaggttgagcgggaccgattcggcgatccgggcgttgtcgggtaggtcggtgagaagtgcccggtgctcggggggaacggcgatcacggcctcgacgccgggcaactcggtggcagccgctactgcgcgcagcagcggagccggcccggtggcgttcagcaccatgcggcccatgcagatgcagacccgccgtgctgaggtgcgcgccgcgccccatgccgggaatgcgccgcttccgttgtacggcacgtactggaccggtgcgccttgcggcgcgtcgcttgcttgcaggctcggcggacagggatcgaggatgagctcgggagtgggcaggccggtcagtccgtggtgccggcacaccgggtcaagcaactcgtgggctcgatcgctgaaggggcctgcggtggggtcgactccccagcggtgcagcacgaccggcaggtcgagcaatccgccgagcacccggccgatcagcgcgcagacgtcgaccaacagcactgacggtcgccaggcctcggccagtcgaaggtattcggggagctgatcgagcgagctttgcgcgacattggacgcggtctgctcccacagttgccggcctgcctcggtgtcgcgctgaccgaacgccggattgggaaagcgcagctgcgtggttccacccgtatcgccggtcctgtcgttcccgcggatcccggccgtggtgagacctgcaccatgcgcggtcgcctgcagctctggtggtgcggcgatcaggacctcgtgcccggatgcttgcagcgcccagcacagcggcaccattgccatgagatgcgtcggatagggcaagggaacgacgagtacgcgcatacttcggaccccagtctctttcccccgattagcgcagcagcccctactcccattggccaggatttggaaaatgcgctgcgtatgtcgatcgccgttgacgtccaacggacttccggcggcaacaatagtgtgtcacggcaggaatgtcacgcgaccatcgaagatctttgggtcgccgcacctggtttcacgcgaacgagtgaaatgcgcgagctccgctcgatcggggtgggccggacctgtacggtgatcaccgttggttctgcggggattcatggggaagatttgcgctggctgtttgcctcctggccggatagttatagtcggtaccgccgcatgcggcggtaaccgcgaattaactgacggctagtttgccgtcttttctctctgtgtgtttcctgctcggttccagaaaattacgagaaggtgaacgttgcagagatcaggcataccggtgttgccaggtggcgcaccaacatcgcagcaggttgggcagatgtatgacctggtcacgccgttgctgaactcggtcgcgggcggcccctgcgccatccaccacggctactgggagaacgacgggcgggcttcctggcagcaggccgccgaccggctcaccgaccttgtcgccgaacggaccgtgctcgatggcggcgttcgactgctcgatgtggggtgcggtaccggacaaccagcgctgcgcgtcgcgcgcgacaacgcgatccagatcaccggcatcaccgtcagccaggtgcaagtggccatcgccgctgattgcgcacgcgaacgcggactaagccaccgggtggacttctcgtgcgtcgatgccatgtccctgccgtacccggacaatgctttcgacgccgcctgggccatgcagtcgctgttggagatgtccgaaccggaccgtgccatccgggaaatccttcgagtactcaaacccggtggcatcctcggcgtcaccgaggtcgtcaaacgagaagcgggcggcgggatgccggtgtccggggacaggtggccgaccggccttcggatctgcctggctgagcaacttctggaatcgctgcgtgcagcggggttcgagatcctcgattgggaggacgtgtcgtcgaggacccggtacttcatgccgcagttcgccgaagagctcgctgcgcaccagcacgggatcgcggacaggtacgggccggctgtcgccggctgggccgccgcggtctgcgattatgagaaatatgcccacgacatgggctatgcgattctgacggcgcggaagccggtcggctgagggcgcgccgcaattcgatgacgttcatgcgccgtgtcggggaatcgccggtggcggcgccagcagaggctgaacttactggtggtgtgtccaggaatcggaggggcagtaccgaatgagcgaagccgggaacctgatagccgtcatcggactgtcctgccgcctaccccaggcgcctgacccggcttccttctggcggttgctgcgcaccggaacggacgccatcaccacggtcccggaagggcggtggggcgacccgttgcctggtcgggatgcgcccaagggcccggaatggggtggtttcctggctgatgtcgactgcttcgatcccgagttcttcgggatctcgccgcgagaagcggcagccgtggatccccagcagaggctggctctggagctcgcctgggaggcactcgaagacgccggtatccccgccggcgagctgcgcggtactgccgccggtgtgttcatgggggcgatctctgacgactacgccgccctgctgcgcgagagcccgccggaagtggctgcgcagtaccgcctcaccggcacccatcgaagcctgatcgccaaccgcgtgtcctatgtgctcggcctgcgcgggccaagcctgacggtggattcaggtcagtcctcgtccctggtcggcgtgcatctcgccagcgagagcctgcgacggggtgagtgcacgatcgcactcgccggcggcgtgaacctcaacctggccgccgagagcaacagcgctctgatggacttcggcgcgctctccccggacggtcgctgcttcaccttcgatgtgcgggcgaacggttacgtccgtggtgagggcggcggccttgtcgtgctgaagaaggccgatcaggcgcacgccgatggcgaccggatctactgcctcatccgcggcagcgcggtcaacaacgatgggggcggtgccgggctcaccgttccggcggcggacgcccaggcggagctgctgcgccaggcataccggaacgcgggcgtcgacccggccgccgtgcagtatgtcgagctccacggcagcgcgaccagggtcggggatcccgtcgaagcagcagccctcggagctgtcctgggggcggcgagacggcccggcgacgagctgcgtgtggggtcggcgaagaccaacgtcggccatctggaagcagcggcgggcgtcaccgggttgctgaagaccgcactcagcatctggcaccgcgaactgccgccgagtcttcatttcaccgcccccaacccggaaatcccgctggacgaattgaacctacgcgtccagcgtgatctgcggccgtggccggagagcgaggggccgctgctggccggcgtcagcgccttcggaatgggaggcacgaactgccacctggtgctctccggcacgtcccgggtggagcgacggcgcagtggacccgctgaggcgaccatgccgtgggtcttgtcggccagaacaccggtcgcattgcgtgcgcaggcggcgcgcttgcacacgcacctcaatacggccggtcaaagtccgttggacgtcgcctactcactggcgaccactcgatccgcgctgccgcaccgggccgcgctggtcgcggacgacgaaccgaaactgctcgccgggttgaaggccctcgctgacggcgacgacgcgcccacgctgtgccacggcgcgacttccggcgagcgggcagcggtcttcgtctttcccggacagggcagccagtggatcgggatgggtaggcagctgctcgaaacctccgaggttttcgcggcgtcgatgtcggactgcgccgacgcattggcgccgcacctggattggtccctgctggatgtgctgcgcaacgcggccggcgctgcgcaccttgaccacgacgatgtcgtccagcccgcgctgttcgccatcatggtctcgctcgcggagctctggcgttcgtggggcgtgcgtccggtggcggtcgtcgggcactcgcagggggagatcgcggcggcctgcgtcgccggggccctgtccgtccgcgatgccgccagggtggtggcggtgcgcagcaggcttctgacggcgctggccggcagtggcgcgatggcctcgttgcagcatcccgccgaagaggtgcggcaaatcctgttgccctggcgcgatcggatcggcgtggcgggggtgaacggaccgtcgtcgaccctggtgtcaggggaccgggaggcgatggcggaactgctggccgagtgcgcagaccgagagctccggatgcgccggattcccgttgaatacgcctcccattcgcctcacatcgaggttgtccgggatgagctgctggggctgttggcgccggtcgaacccaggacgggaagcatcccgatctattcgacgacgaccggggacctgctggaccggccgatggacgccgactactggtaccgcaaccttcgtcaaccggtgctgttcgaagcggccgtcgaggccctgttgaagcgggggtacgacgcattcatcgagatcagcccacacccggtgctgactgcgaacatccaggaaaccgccgtgcgagcagggcgggaggtagtggcgctcgggacactccgccgcggcgaaggtggcatgcggcaggcgctgacgtcgctggccagagcacacgtacacggagtggccgcggactggcacgcggtcttcgccggtaccggggcgcagcgggtcgacctgccgacgtacgcctttcagcgacagcgctactggctggacgcgaagcttcccgacgtcgccatgcccgagagcgacgtgtcgacggcgttgcgggaaaagctgcggtcttcgccgagggcggacgtggactcgacgaccctcacgatgatccgggcacaggcagccgtggtcctcggccactccgatccgaaagaggtggacccggatcggacgttcaaggacctgggcttcgattcctcgatggtggtcgagctgtgcgaccgcctaaacgccgccacaggtctgcgactcgcaccgagcgtcgttttcgactgtcctacgccggacaagctcgcccgccaggtacggacgttgttgttgggcgagccggctcccatgacgtcacaccggccggactccgatgcggacgagcctatcgccgtgatcgggatgggctgtcggtttccgggtggggtgtcctcgcccgaggagttgtggcagttggtcgccgctgggcgggacgtcgtgtccgagttcccggctgaccgaggttgggacctggagcgtgcggggacatcgcacgtgcgcgccggcgggttcttgcatggcgccccggattttgaccccgggttcttccggatttcgccgcgcgaggcgttggcgatggatccacagcagcggttgctgctggaaatcgcctgggaagcagtcgaacgaggcgggatcaacccgcagcacctgcacggaagtcaaaccggggtcttcgtcggcgcgacctccctggactacgggccacgcctgcacgaagcgtccgaggaggcggccgggtacgtgctcaccggcagcaccacgagtgtggcgtcgggtcgggttgcgtattcgttcgggttcgagggccctgcggtgacggtggatacggcgtgttcgtcgtcgttggtggccctgcatttggcgtgtcagtcgttgcgttcgggtgagtgtgatctggcgttggccggtggtgtgaccgtgatggccacgccggggatgttcgtggagttttcgcggcagcgtggtttggcgccggatgggcggtgcaagtcgttcgcggaggccgccgacggcaccggctggtccgagggtgctggcctggttctactggagcggttgtcggatgcccggcggaatgggcatgaggtgctggcggttgttcgtggtagtgcggtgaatcaggacggtgcgtcgaatggtttgaccgcgccgaatggttcgtcgcagcagcgggtgattgcccaggcattggcgagtgcggggttgtcggtgtccgatgtggatgctgtggaggcgcatgggacgggcacgcggcttggtgatccgatcgaggcgcaggcgctgatcgccacctacggccagggccggcttccggaacggccattgtggttgggctcgatgaagtcgaacatcggtcacgcgcaggcagctgcggggatagccggcgtcatgaagatggtgatggcgatgcggcacgggcagctaccgcgcacgttgcacgtggatgagccgacttctggggtggattggtcggcggggacggttcaactccttacggagaacacgccctggcccgggagtggtcgtgttcgtcgggtgggggtgtcgtcgttcgggatcagtggtactaacgcgcacgtcatcctcgaacagcccccgggagtgccga

SEQ ID NO: 2 - DNA, 50000 bp, Saccharopolyspora spinosa
gtcagtctgcggggccgggttcgggctctgtcgtggatgttccggtggtgccgtggatggtgtcgggcaaaacacccgaagcgctatccgcgcaggcaacggcgttgatgacctatctggacgagcgacctgatgtctcctcgctggatgttgggtactcgctggcgttgacacggtcggcgctggatgagcgagcggtggtgctggggtcggaccgtgaaacgttgttgtgcggtgtgaaagcgctgtctgccggtcatgaggcttctgggttggtgaccggatctgtgggggctgggggccgcatcgggtttgtgttttccggtcagggtggtcagtggctggggatgggccgggggctttaccgggcttttccggtgttcgctgctgcctttgacgaagcttgtgccgagctggatgcgcatctgggccaggaaatcggggttcgggaggtggtgtccggttcggatgcgcagttgctggatcggacgttgtgggcgcagtcgggtttgttcgcgttgcaggtgggcttgctgaagttgctggattcgtggggggttcggccgagtgtggtgttggggcattcggtgggcgagttggcggcggcgttcgcggcgggtgtggtgtcgttgtcgggtgcggctcggttggtggcgggtcgtgcccggttgatgcaggcgttgccgtctggcggtgggatgctggcggtgcctgctggtgaggagctgttgtggtcgttgttggccgatcagggtgatcgtgtggggatcgccgcggtcaacgctgcggggtcggtggtgctctctggtgatcgggatgtgctcgatgaccttgccggtcggctggacgggcaagggatccggtcgaggtggttgcgggtgtcgcatgcgtttcattcgtatcggatggatccgatgctggcggagttcgccgaattggcacgaaccgtggattaccggcgttgtgaagtgccgatcgtgtcgaccttgaccggagacctcgatgacgctggcaggatgagcgggcccgactactgggtgcgtcaggtgcgagagccggtccgcttcgccgacggtgtccaggcgctggtcgagcacgatgtggccaccgttgtcgagctcggtccggacggggcgttgtcggcgctgatccaggaatgtgtcgccgcatccgatcacgccgggcggctgagcgcggtcccggcgatgcgcaggaaccaggacgaggcgcagaaggtgatgacggccctggcacacgtccacgtacgtggtggtgcggtggactggcggtcgttcttcgccggtacaagggcgaagcaaatcgagctgcccacctacgccttccaacgacagcggtactggctgaacgcgctgcgtgaatcttccgccggcgacatgggcaggcgtgtcgaagcgaagttctggggcgccgtcgagcacgaagatgtggaatcgcttgcacgcgtattgggcattgtggacgacggcgctgctgtggattccctgagaagcgcccttccggtgttggccggttggcagcgaacccgcaccaccgagtccattatggatcagcggtgttaccgaattggctggcggcaggtagccggactcccgccgatgggaactgttttcggtacctggctggtcttcgcgcctcatggctggtccagcgaaccggaggtggtggactgcgttacggcactgcgggcacgtggtgcctcggtggtgttggtggaagctgatcccgacccgacctccttcggcgaccgggtacgaaccctgtgttcgggccttccggatcttgttggcgtgttgtcaatgttgtgcttggaagaatcggtccttccgggattttctgcggtgtcacggggttttgcgttgaccgtggagttggtgcgggttttgcgggcagctggtgcgactgcccggttgtggttgctgacgtgtggtggcgtgtcggtgggagatgtaccggttcgtccagcgcaggccctggcgtgggggttggggcgtgttgtggggttggagcatccggactggtggggcggcttgatcgatattccggtcttgttcgacgaagacgctcaagagcggttgtcgattgtgctggcaggtctcgatgaggacgaggtcgcgatccgtcctgacggcatgttcgcgcgtcggttggtacgccacactgtctcagctgatgtgaagaaggcgtggcgccccaggggatcggtgctggtgacgggcggcacgggtggtttgggggcgcacgttgctcgctggctggccgacgccggagccgaacatgtggcgatggtgagtcgacgcggcgagcaggcaccgagtgctgagaagttgcggacggaactggaggatctgggtacccgggtgtcgatcgtgtcatgcgatgtgaccgatcgcgaggcgctcgccgaagtgctgaaagcccttccggctgaaaacccgttgaccgcggtagtgcatgcggcaggcgtgatcgagactggtgatgcggcggcaatgagcctggctgatttcgatcacgtgttgtccgcaaaggtggccggtgccgcgaatctggatgccttgttggccgatgtggaattggacgcgttcgtcttgttctcatcggtgtcaggagtttggggcgctgggggacacggggcttacgcagcggcgaatgcctatctggatgcgctcgcggaacagcgtcggtcgcgagggctggtcgcgactgcggtggcctgggggccgtgggccggcgagggcatggcctccggagaaacaggagaccagctgcgccgatacggcctttccccaatggctccgcagcacgccatcgccggaatccggcaggccgtggaacaggacgaaatttccctggtagtggccgatgtcgattgggcacgtttcagcgcgggattgctggcggctaggccgcggccgctgctgaacgaactggccgaggtcaaggaactcctcgtcgatgcccagcccgaggcgggagtccttgccgacgcgtcgttggaatggcggcagcgattgtccgcggcaccgaggccgacacaggaacagctgatcctggagctggtacgcggcgaaaccgctctggtgctgggacaccccggggcagcggccgttgcatcggaacgagccttcaaggacagcggattcgactcgcaggccgcggtcgaactccgcgttcggctcaatcgagctaccggcctccagttgccatcgacaattatcttcagccatcccacgcctgcggaactggctgcggagctgcgggcgaggcttcttcccgagtccgcaggagcaggcattcccgaggaggacgaggcgcgaatcagagcggcactgacgtcgatcccgttcccggccttgcgcgaggcaggcttggtgagtccgctgctcgcacttgccggacacccggtcgactccggtatctcctcggacgatgcggccgcgacctcgatcgatgcgatggatgtagccggcctcgtcgaagcagcgctgggcgaacgcgagtcctgagaccgccgacctgggagatgacggtgaccaccagttacgaagaagttgtcgaggcactgcgagcatcgctcaaggagaacgaacgcctccggcgcggcagggatcggttctccgcggagaaggacgatcccatcgcgatcgtggcgatgagttgtcgttatcccggtcaggtctcctcgccggaggacctgtggcaactggctgccggcggtgtggacgcgatctccgaagttccgggggatcgcggatgggacctggatggcgtgttcgttccggactccgatcgtcctggcacgtcgtatgcctgcgcgggcggttttcttcagggcgtgtcggagttcgacgcgggtttcttcgggatttcgccgcgtgaggcgctggcgatggatccgcagcagcggttgctgctggaagtcgcgtgggaggtcttcgagcgggctgggctggagcagcggtcgacacgcggttcccgcgttggcgtgttcgtcggcaccaatggccaggactacgcgtcgtggttgcggacgccgccgcctgcggtggcaggtcatgtgctgacgggcggtgcggcagcggttctttcgggccgggttgcgtattcgttcgggttcgagggtcctgcggtgacggtggatacggcgtgttcgtcgtcgttggtggcgttgcacctggcggggcaagcactgcgggccggtgagtgcgaccttgcccttgccggtggcgtcacggtgatgtcgacgccgaaggtgttcctggagttctcccgccaacggggtctcgcgccggatgggcggtgcaagtcgttcgcggcgggtgcggatggcactggatggggtgagggtgccggactgttgttgctggagcggttgtcggatgcccggcggaatgggcatgaggtgctggcggttgttcgtggtagtgcggtgaatcaggacggtgcgtcgaatggtttgaccgcgccgaatggttcgtcgcagcagcgggtgattacccaggcgttggcgagtgcggggttgtcggtgtccgatgtggatgctgtggaggcgcatgggacgggcacgcggcttggtgatccgatcgaggcgcaggcgctgatcgccacctacggccgtgatcgtgatcctggccggccgttgtggttggggtcggtcaagtcgaacatcggtcatacgcaagcggcggcgggtgtggctggtgtgatcaagatggtgatggcgatgcggcacgggcagctgccacgcacgttgcacgtggaatcgccgtcgccggaggtggattggtcggcggggacggttcaactccttacggagaacacgccctggcccaggagtggtcgtgttcgtcgggtgggggtgtcgtcgttcgggatcagtggtactaacgcgcacgtcatcctcgaacagcccccgggagtgccgagtcagtctgcggggccgggttcgggttctgtcgtggatgttccggtggtgccgtggatggtgtcgggcaaaacacccgaagcgctatccgcgcaggcaacggcgttgatgacctatctggacgagcgacctgatgtctcctcgctggatgttgggtactcgctggcgttgacacggtcggcgctggatgagcgagcggtggtgctggggtcggaccgtgaaacgttgttgtgcggtgtgaaagcgctgtctgccggtcatgaggcttctgggttggtgaccggatctgtgggggctgggggccgcatcgggtttgtgttttccggtcagggtggtcagtggctggggatgggccgggggctttaccgggcttttccggtgttcgctgctgcctttgacgaagcttgtgccgagctggatgcacatctgggccaggaaatcggggttcgggaggtggtgtccggttcggatgcgcagttgctggatcggacgttgtgggcgcagtcgggtttgttcgcgttgcaggtgggcttgctgaagttgctggattcgtggggggttcggccgagtgtggtgttggggcattcggtgggcgagttggcggcggcgttcgcggcgggtgtggtgtcgttgtcgggtgcggctcggttggtggcgggtcgtgcccggttgatgcaggcgttgccgtctggcggtgggatgctggcggtgcctgctggtgaggagctgttgtggtcgttgttggccgatcagggtgatcgtgtggggatcgccgcggtcaacgctgcggggtcggtggtgctctctggtgatcgggatgtgctcgatgaccttgccggtcggctggacgggcaagggatccggtcgaggtggttgcgggtgtcgcatgcgtttcattcgtatcggatggatccgatgctggcggagttcgccgaattggcacgaaccgtggattaccggcgttgtgaagtgccgatcgtgtcgaccttgaccggagacctcgatgacgctggcaggatgagcgggcccgactactgggtgcgtcaggtgcgagagccggtccgcttcgccgacggtgtccaggcgctggtcgagcacgatgtggccactgttgtcgagctcggtccggacggggcgttgtcggcgctgatccaggaatgtgtcgccgcatccgatcacgccgggcggctgagcgcggtcccggcgatgcgcaggaaccaggacgaggcgcagaaggtgatgacggccctggcacacgtccacgtacgtggtggtgcggtggactggcggtcgttcttcgccggtacgggagcgaaacaaatcgagctgcccacctacgccttccaacgacagcggtactggctggtgccatcggattccggtgatgtgacaggtgccggtctggccggggcggagcatccgctgttgggtgctgtggtgccggtcgcgggtggtgacgaggtgttgctgaccggcaggatttcggtgcggacgcatccgtggctggccgaacaccgggtgctgggtgaagtgatcgttgcgggcaccgcgttgctggagatcgccttgcacgcgggggaacgtcttggttgtgaacgggtggaagagctcaccctggaagcaccgctggtcctgccggagcgcggggcgatccaggttcagctgcgagtgggcgcgcccgagaattccggacgcaggccgatggcgctgtattcacgccccgaaggggcggcggagcatgactggacgcggcacgccacgggccggttggcgccaggccgcggcgaggcggctggagacctggccgactggccggctcctggcgcgctgccggtcgacctcgacgaattctatcgggacctcgcagagcttgggctggagtacggcccgatcttccaagggctcaaggcggcctggcggcaaggggacgaggtgtacgccgaagccgcgctgccgggaacggaagattctggtttcggggtgcatccggcactgctggacgcggctctgcacgcaacggctgtccgagacatggatgacgcacgcttgccgttccagtgggaaggtgtgtccctgcacgccaaggccgcgccggctttgcgggtccgcgtggtcccggctggtgacgatgccaagtccctgctggtttgtgatggcaccggtcgaccggtgatctcggtggaccgactcgtattgcggtcggctgcggcccggcggaccggtgcgcgccgacaggcccatcaagctcggttgtaccggttgagctggccaacggttcaactgccgacatccgctcagccaccgtcctgcgtgcttctcggcacctcagaagtgtccgctgacatacaggtgtatccggacctccggtcgttgacggctgcgttggatgccggtgccgaaccacccggcgtcgtcatcgcacccacgccccccggcggtggacgaacagcggatgtccgggagacgactcggcatgcactcgacctggtacaaggctggctttccgatcagcgactcaacgaatcccgattgctcctggtgacacagggagcagtggccgtggagccgggcgaacccgtgaccgatctggcgcaggccgcgctctggggactgctgcggtcgacgcagaccgaacaccctgatcgcttcgtcctcgtcgatgtgcctgagcccgcgcaactcctccccgcgctgccgggggtgctggcctgcggcgaacctcagctcgcgttgcgacgtggcggcgctcatgcgcccagactggctggactgggcagcgatgacgtcctgcccgtgccggacggcaccgggtggcgattggaggccacgcgcccgggaagcctggatgggttggcattggtggacgaaccgacggccacggcaccgctgggtgacggtgaggtcaggattgcgatgcgcgcggccggggtgaacttccgggatgcgctcatcgcgctcggtatgtatcccggtgtggcatcgctgggcagtgagggcgccggggtcgtggtggagaccggccccggcgtcaccggcctggcacccggcgaccgcgtgatgggaatgatcccgaaggcgttcgggccgctcgcggtcgccgaccatcgcatggtgacgaggattcccgctggttggagcttcgcgcgggccgcatcggtgccgatcgtctttctcaccgcctactacgcgctggttgatctcgccgggttgagaccaggggagtcgttgctggttcattcggccgccggtggggtggggatggccgcgatccaactcgccaggcacctcggtgcagaggtgtacgccaccgctagcgaggacaagtggcaagccgtggagctgagccgagaacacctcgcttcgtcgcggacgtgcgatttcgagcagcagttcctcggggcaaccggcggacgcggcgtcgacgtcgtgctcaactccctcgccggggagttcgccgatgcgtctctgcgaatgctgccgcgcggtggccgtttcctggagttggggaagacggatgttcgtgaccccgtcgaggtcgccgatgcgcatccgggcgtgtcttaccaggctttcgataccgtagaggcaggcccgcagcgaatcggcgagatgcttcacgagctggtggagttgttcgagggacgcgtgctggagcccctgcctgtcacggcttgggacgttcggcaggcgcccgaggcgctacggcacctgagccaagcgcggcatgtgggaaagctggtgctcaccatgcctccggtgtgggacgccgcaggcacggttctggttaccggcggaacgggagcacttggcgcagaggtcgcccggcacctcgtgatcgagcgcggggtgcgaaacctggtcctcgtcagcaggcgcggtcccgcagccagtggcgctgctgagctcgtggcgcaactgacggcctacggtgccgaggtttccttgcaggcttgcgatgtcgccgatcgtgagaccttggcgaaggtgcttgccagcatcccggacgagcatccgttgaccgccgtggtgcacgcggctggtgttctcgacgacggagtgtccgaatcgctcaccgtggagcggctggaccaggttctgcgcccgaaggtcgatggcgcgcggaatctgctcgagctgatcgacccggacgtggccctcgtgttgttctcgtcggtgtcgggtgtgctcggcagcggtgggcagggtaactacgcggcggccaactccttcctcgacgcattggcgcagcaaaggcagtcgcgcggcctaccgacgagatcattggcctgggggccctgggcggaacatggcatggccagcaccttgcgcgaagccgagcaggatcgattggcgcgatctgggttgctgccgatctcgaccgaggaggggttgtcccagttcgacgccgcgtgcggcggcgcgcataccgtggtggcgccggttcgattcagccgcttgtccgacgggaacgcgatcaagttctccgtcctgcaaggtttggtcgggccgcatcgcgtcaacaaagcggcgactgcggatgatgccgagagcctccggaaacggttgggacgcttgccggatgcagaacaacatcggattctgctggacctcgtccgcatgcatgtggcggcagtgctcggattcgccggttctcaggagatcaccgcggacggcacgttcaaggtgctgggcttcgactcgttgaccgtggtcgagttgcgcaaccggatcaacggggcgacggggctgcgactgcccgccaccctggtgttcaactacccgacgccggatgcgctcgccgcgcacctcgtcaccgcgctgtccgcagaccgcctggccgggacattcgaggaactcgacaggtgggcggcgaacctgcccacgctggccagggatgaggccacgcgggcgcagatcaccacccggctacaggcgatcttgcagagcctggcggacgtgtccggcggaaccggcggcggctccgtgccggaccggctcagatcggccacggacgacgagcttttccaactcctcgacaacgatctcgaacttccctgatgcctcagccggagccttcgcaacttcctggagggaaacgccacatgtcgaatgaagagaagctccgggagtacttgcggcgtgcgctcgtggatctgcaccaggcgcgcgagcggctgcacgaggcggagtcgggagagcgggaacccatcgcgatcgtggcgatgggctgccggtacccgggtggggtgcaggacccggaagggctgtggaaactggtcgcctccggtggcgacgccatcggtgaattccccgctgatcgtggttggcacctcgacgagctctacgatcccgacccggatcagcccggaacctgctacacccggcacggcggcttcctccacgacgccggcgagttcgacgcgggattcttcgacatcagcccccgtgaggcgctcgcgatggacccgcagcagcggctgctgctggaaatctcctgggagaccgtcgaatccgctgggatggacccgaggtccttgcgggggagccgcaccggggtgttcgcgggattgatgtacgagggctatgacaccggcgcccaccgggcaggagaaggtgtcgaaggctatctcggaaccggcaatgcgggaagcgtcgcctctggtcgggttgcgtatgcgttcgggttcgagggcccagcggtgacggtagacacggcgtgctcgtcgtcgttggtggcgctgcatttggcgtgtcagtcgttgcggcagggcgagtgtgatctggcgctggccggtggagtgacggtgatgtcgacgccggagaggttcgtggagttctcccgtcagcgtggtctcgcaccggatgggcggtgtaagtcgttcgcggcggctgcggatggaaccggttggggtgagggtgccggtttggtgttgctggagcggctgtcagacgccaggcggaacgggcatcgggtactggcggttgttcgtggtagcgcggtgaatcaggacggtgcgtcgaacggattgacggccccgaacgggctggcccaggagcgggtcattcagcaggtgctcacgagtgcggggctgtcggcgtccgatgtggacgctgtggaggcgcatggaacgggtacgcggcttggtgatccgatcgaggcgcaggctctgatagccgcctatggacaggatcgggaccgggaccggccgctgtggttggggtcggtcaagtccaacatcggtcatacgcaggcggctgcgggcgtcgctggtgtgatcaagatggtcatggcgatgcggcacggggagctgccgcgcacgttgcacgtggacgagccgaattcgcacgtggactggtcggctggtgcggtccgactcctgaccgagaacatccgctggccagggacgggtacgcgccgcgctggagtgtcgtcgttcggggtaagcggtaccaacgcacacgtcatcctcgaacacgacccgctcgccgtgaccgagaacgaggaagcagcgcagtccccagcacctgggatcgtgccctgggcgttgtccgggcggtcgtcgacggcgctgcgggcccaggccgaacggctgcgcgagctgtgcgagcagaccgatcccgaccccgtcgatgtcggtttctcactggccgccacgcgcacggcttgggagcaccgagcggtggtgcttggtcgggacagcgctacgttgcgctccgggcttggcgttgttgccagcggtgaaccagcggtcgatgtcgttgaggggagcgtcctggacggcgaggtcgtcttcgtcttccccggtcagggctggcagtgggccggtatggcagtcgacctgctggacgcttcgccgacgttcgcgcgccacatggacgagtgcgccaccgcgctgcggaggtacgtggactggtcgttggtcgacgtgctgcgcggagcggagaactccccaccgctggaccgggtggacgtgctccagcccgcgtccttcgcggtgatggtgtcgctcgccgaggtgtggcgttcctacggggtgaggccggcggccgtcgtcggccacagtcaaggcgaaatcgccgcggcctgcgcagccggggtgctgccgctggaggatgcggccaggcttgtcgcattgcgcagcagagcgttgaagggactttcggggcggggtggcatggcgtcgctggcctgccctgcggatgaggtcgcggcattgttcgcgggatcgggcggccgtctggaagttgcggcgatcaacggcccgcgatcggtcgtggtgtccggcgatctggaagcggtggacgaactgctggcagagtgcgctgaaaaggacatgcgtgcacgccgtatccccgtcgactacgcctcgcattcagcgcacgtggaggtggttcggagcccggtgctggcggccgccgccggggtgcgacaccgggacggccaggtgccgtggtggtcgacggtgatcggcgactgggtggatccggccaggctggacggcgagtattggtatcggaacctccggcagccggtccggttcgaacacgccgtgcagggcctggtcgagcggggattcggcctgttcatcgaaatgagtgcgcatccggtgctgaccacggcggtcgaggaaaccggtgcggagtcggagaccgccgtggccgcggtaggtaccttgcgacgtgactcgggcggcctccggaggttgttgcattcgctggccgaggcgtacgtgcgcggcgccaccgtggactgggccgtggcgttcgggggcgcgggccgacggctggacctgccgacctacccgttccagcgccagcggtactggctggacaagggagctgcctccgacgaggctcgtgcggtctcggacccggcggcgggctggttctggcaagccgtggcgcgccaagacctgaaaagcgtgtccgatgccctcgatctcgacgccgacgcaccgctgagcgcaacacttccagccctgtccgtctggcaccgtcaggaacgagaaagggtcttggcagacggttggcggtaccgagtcgactgggtacgggtggccccgcagccggtccggagaacgcgggaaacctggctcctggtcgttcccccgggcggcatcgaggaagcgctggtcgaacggctgacggatgcgttgaacacgcgagggatcagcaccctgcgcctcgacgtgccaccggcggcgaccagtggcgaactcgcaaccgaactccgcgccgcagccgacggtgacccggtgaaggcaatcctgtcgctcaccgcgttggacgagcgaccccaccccgaatgcaaggacgtcccgagcgggattgccttgctgctgaacctggtcaaggcgctcggtgaagccgacctcagaattcctctgtggaccatcacgcgtggtgcggtcaaggcaggccccgcagatcggctgctgcgcccgatgcaggcgcaagcatggggtctggggcgagtagccgcactcgaacaccccgagcgctggggtgggctgatcgacctgccggattcgctggacggcgacgtcctcacgaggctgggcgaagcgctcaccaacggcttggcggaagaccaactggcgattcgccagtcgggcgtgctggcccggcgactggtacccgccccggcgaatcagcccgctggacgtaagtggcgcccccgagggagcgcgctgatcacgggcggactcggcgcggtgggcgcacaggtggcgaggtggttggccgaaatcggagccgagcgaatcgtgctcaccagtcgacggggcaaccaagcagcaggcgccgccgagctggaagccgaactccgggcccttggagcgcaagtgtccatcgtggcttgcgacgtgaccgatcgtgccgagatgtccgcactactggccgagttcgacgtcaccgcggtgttccacgcggccggagtcggtcggctgctgccgttggcggagaccgaccagaacggcctggccgaaatatgcgcggcgaaggtccgcggcgctcaggtgctggacgaactgtgcgacagcaccgatctcgatgccttcgtcctgttctcctcgggtgccggggtatggggcgggggcggtcagggcgcttacggcgcggcgaacgcattcttggacacactcgccgaacaacgccgagcacgcggtctgccggcaacctcgatctcctggggcagttgggccggcggcggcatggccgacggcgcggcgggcgaacacctgcggcgacgcgggatacgtccgatgccggcggcgtcggccatcctggctctgcaggaagtacttgaccaggatgagacgtgcgtgtcgatcgctgatgtggactgggaccgattcgttcccacgttcgccgcgactcgcgccacccggttgttcgacgaagtgccggcggcgagaaaggcgatgcccgcgaatgggccggcagaaccaggcggctcgccgttcgcccgcaatctcgcggagctgccggaagcccaacgacgccacgaactggtggatctggtgtgcgcccaggtggcaaccgtgctcgggcacggcagtcgcgaggaagtccagcccgagcgggcgttccgcgcgctcgggttcgactccctcatggcggtggatctgcgcaatcgtttgaccaccgccaccgggttgcgcctgccgaccacaaccgtcttcgactacccgaatccggccgccttggccgctcacctgctcgaggagctggtgggtgatgtcgcgtcggctgcggtgaccgctgccagcgcgcccgcgagtgacgaaccgatcgcgatcgtcgcgatgagctgccggtttccgggtggcgcgcactcgccggaagacctgtggcggctggtcgccgccggcacggaggtgatcggcgagttcccctccgaccggggctgggatgcggaaggcctttacgatccggatgcttccaggcctggaacgacgtatgcgcggatggcgggattcctctacgacgccggtgagttcgatgccgacctgttcggcatcagcccacgtgaggcgttggcgatggatccgcagcagcggttggtgctcgaaatcgcctgggaagccctcgaacgggccggaatcgatccgttgtccttgaagggcagtggggtcggcacgtacatcggcgctggaagccgtgggtacgcgacggatgtgcggcagtttcccgaggaggcggagggctacctgctgacgggtacctcggccagtgtgctgtcgggtcgggtcgcgtattcgtttggtttcgagggtcctgcggtgacggtggatacggcttgttcgtcgtcgttggtggcgttgcatctggcgtgccagtcgttgcgttcgggcgagtgtgatctggcgttggccggtggtgtgaccgtgatgtcgacgccggagatgttcgtggagttctcccgtcagcgcggtttggcgccggatgggcggtgcaagtcgttcgcggagagcgcggacggcaccggctggggcgaaggcgcgggcctgttgttgctggagcggttgtcggacgcccaccggaatgggcatcgggtgttggcggtggttcgtgggtcagcggtgaatcaggacggcgcctcgaacggactggcggcgccgaacggtccgtcgcagcagcgggtgatcaaccaggcactcgcgaatgcggctctttcggcgtccgatgtggatgcggtggaggcacatggcaccgggaccaggctgggtgatccgatcgaggcgcaggcattgatcgcaacgtatgggcaggcccgggagcgggatcggcccttgtggctggggtcggtcaagtcgaacatcggtcatacgcaggccgcggcgggtgttgccggtgtgatcaagatggtgatggccatgcggcacgggcagctgcccgcctcgctgcacgcggatgagcccacgtcggaggtcgattggtcgtcgggggcggtccggctcctcgccgaacaggtaccttggccggagtctgaccgtgttcgtcgggtgggggtttcgtcgttcgggatcagcggcaccaacgcacatgtgatcctcgaacaagctacgaatgcgccagatagtacagcggagacggacaaaacagaatccggatctactgtcgatattccggtcgttccctggttggtgtcgggaaagacgacggattccctgcggggacaagccgaacgagtcttgtctcaggtcgagtcccggccggagcagcgttcgctggatgttgcctactcgcttgcttctggccgagccgcgctggatgaacgcgctgtcgtgctgggtgcggaccgcggtgagctggttgctggactggcggcgttggccgccggtcaggaggcttctggggtgatcagcggaactcgtgcttctgctcggttcgggttcgtgttctcggggcagggtggtcagtggttggggatgggcagagcgctctactcgaagtttccggtgttcgctgctgcgtttgatgaggcttgcgccgagttggaggcacatctgggggaagaccgccgggttcgggatgtggtcttcggttccgatgcgcagctgctggatcagacgctgtgggcgcagtcgggtctgttcgcgctgcaagccggcctcttggggctgctgggttcgtggggcgttcggccggatgtggtgatggggcattcggtcggggagttggccgccgcgtttgcggctggcgtgttgtcgttgcgggatgcggctcggttggtggccgcgcgcgcccggttgatgcaagccctgccctctgacggcgcgatgttggcggtggctgctggtgaagaccttgttcggccattgctggccggtcgggaggagtccgtgagcgtcgccgcgctcaatgcccccggttcggtggtgttgtcgggcgatcgggaggtgctggccagcatcgtcggccggctgaccgagctccgagtccggacgcggcgcttgcgggtctcccatgcttttcattcgcaccggatggacccgatgttgggcgagttcgcccagatcgccgagtctgcggagttcggtaagccaacgacaccgcttgtgtcgacgttgacgggtgagctcgacagagccgcggaaatgagcacaccagggtattgggtgcgccaggcgcgtgaacccgtccgtttcgccgacggtgtccaggccctggcagcgcagggcataggcacggtcgtcgagctcggcccggacggaacgctggcggcactggttcgggagtgtgcgaccgagtccgatcgggttgggcggatttcgtcgatcccactgatgcgcagggagcgggacgagacccgttcggtgatgacagccctggcgcatctccacacccgtggtggtgaggtggactggcaggcgtttttcgccggtaccggcgctaggcagctcgagttgccaacgtatgccttccaacgacagcactactggatcgagtccagtgcgcggccagcacgcgaccgcgcagacatcggcgaggtggcggaacagttctggaccgcggttgaccaaggcgatctggcaacgttggtcgccgctctggatcttggggcggacgacgacacatgcgcatcgttgagcgatgtattgccggcgttgtcctcctggcgaagcggactccgcaaccgttcgctcgtcgattcctgccggtaccgaatcagttggcattcctctcgggaggtgccggccccgaagatttccggtacctggctgttggtcgtgcccggtgctgcggatgacggattggtcacggctttgacgagttcactggtcggaggcggcgccgaggtcgtccggatcggcctgtccgaagaggacccgcaccgcgaggacgtcgcacagcggctggccaatgcgctgacggatgccggtcaactcggtggcgtgctttcgctgttggggctcgatgaatcgcctgctccgggattctcctgcttgccaactggtttcgcgctgactgtgcagcttctgcgggccttgcggaaggccgacgtcgaggcgcctttttgggcggtgacgcgcggcggcgtcgcgttggaagatgtacgcgtgtctccggagcaggccctggtctgggggctgctgcgtgtcgcgggactggagcacccggagttctggggtggcttgatcgacctgccatcggactgggacgaccgattgggtgcccggttggcgggtgtgttggcggatggtggcgaggatcaagtcgccattcgccgtggtggtgtgttcgtgcggcggttggaacgcgctggtgcgtcgggtgccgggtcggtgtggcgtcctcgggggacggtgttggtgacgggtggtacgggcggtttgggggcgcatgttgcccggtggttggccggtgccggggctgagcacgtggtgttgaccagccgtcgaggagcggacgctccgggcgctggggaattgcgggcggagctggaggcgctgggtgctcgggtgtcgattgtgccctgcgacgtggctgatcgtgacgcagtggctggagtgttggcagggatcggtggggagtgtccgctgactgcggtggtacacgccgccggggtcggcgaggcgggcgacgtagtggagatgggtttggcggattttgcagcggtgttgtcggcgaaggtgcgtggtgcggcgaatctggacgagttgctggccgactcggagctggatgcgtttgtgatgttctcctcggtgtcgggggtgtggggagccggcggacagggtgcgtatgcggctgcgaacgcctacttggatgcgttggccgagcagcgtcgggcgaggggattggtcgggaccgcggttgcgtggggaccgtgggccggtgacggcatggccgccggcgaaaccggcgcacagctgcaccggatgggcctggcgtcgatggaaccgagcgcggcgctgctggcacttcagggtgcattggaccgcgatgagacctccctcgtcgtggccgatgtcgattgggcacggttcgccccagccttcacctcggcacgtcgacgcccgctgctggacaccatcgacgaggcccgagccgcattggaaaccaccggcgaacaagcgggcacaggcaaacccgttgagctgacgcaacgcctggccggactgtcgcggaaggaacgcgacgatgcggtattggatctggtgcgggcggagacggcggctgtgctgggacgcgacgatgccacggccctggcgccatcgcggccgttccaggaactcggattcgactccttgatggcggtggagctgcgcaaccggctgaacaccgccaccgggatccagctgcccgccagcacgattttcgactaccccaatgccgagtcgctgtcgcgtcacctctgcgccgagcttttcccaacggagactaccgtggactcggcccttgccgagctcgatcgaatcgagcagcagctctcgatgctcaccggcgaagcgcgggcacgggaccgaatcgcgacacgactgcgagccctccacgagaagtggaacagcgcagctgaagtaccgaccggagccgatgtcctgagcacgctcgattcggcgacgcacgacgagatattcgagttcatcgacaacgagctcgacctgtcctgagcagttcctgcggaacttcaagcgccgaaatcgggtggaaatcacaatggccaatgaagaaaagctcttcggctatctgaagaaggtaactgcggacctgcatcagacccggcagcgcctgctcgcggccgagagccggagtcaggagccgatcgcgatcgtctcggcgagctgccgactgcccggcggcgtcgactctcccgaagcgctctggcaactcgtgcgcactggcaccgacgccatctcggagttccccgccgaccggggctgggatctcggccggttgtacgatcccgacccgaaccaccagggaacgtcgtacacgcgggccggcggtttcctcgcaggagcgggcgatttcgaccccgccatgttcgggatttcgccgcgtgaggcgttggcgatggacccgcagcaacggttgttgctggagctgtcctgggaggccctcgaacgggcgggcatagacccgacatccctgcgcggcagcaagaccggtgtcttcggtggtgtcacgccccaggagtacgggccgtccttgcaggagatgagccgaaacgctgggggttttggactcaccgggcggatggtgagtgtggcgtcgggtcgggttgcgtattcgtttggttttgagggtcctgcggtgacggtggatacggcgtgttcgtcgtcgttggtggccctgcatttggcgtgtcagtcgttgcgttccggcgaatgcgatctcgcgctggccggcggtgtgacggtgatggcgacaccggcgacgttcgtggagttctcccgtcagcgtggtttggctccggacgggcggtgcaagtcgttcgcggctgccgcggatggcaccgggtggggtgagggtgccggtctggtgttgctggagcggttgtcggatgcgcggcggaatgggcacgaggttctggcggtggtgcggggtagcgcggtgaaccaggacggcgcgtcgaatggtttgactgcgccgaatggtccgtcgcagcagcgggtgatcacccaggcgttggcgagtgcggggctgtcggtttccgatgtggatgcggtcgaggcacatgggaccgggaccacgttgggtgatccgatcgaggcacaggccctgatcgccacgtacgggcagggccgggagaaggatcggccgttgtggttggggtcggtcaagtccaacatcggtcacacgcaggcggccgctggcgttgccggcgtcatcaagatggtcttggcgatgcggcacgggcagctgcccgccacgttgcatgtggatgagcccacgtcggcggtggactggtcggcgggttcggtccggcttctcacggagaacacgccctggccggacagtggtcgtccttgccgggtgggggtgtcgtcgttcgggatcagcggcaccaacgcacatgtgattctcgaacagtctccagtcgagcagggcgaaccggccgggccggtcgaaggcgagcgggaaccggatgtagccgtccccgtggtgccttgggtgctgtcgggtaagacaccggaggctgcgcgggcgcaggccgaacgggtgcattcgcatatcgaggaccggccggggctgtcgccggtggatgtggcgtattcgctaggaatgacacgcgcggcgctggatgaacgcgcagtggtgttgggctcggaccgtgccgcgctcctgaccgggttgagggcattcgccgacggctgcgatgcgcccgaagtggtttcggggtctgtggggcttggtggccgcgtcgggttcgtgttctcgggtcagggtggtcagtggccggggatgggccgggggctctactcggtgtttccggtgttcgccgacgcgttcgacgaggcttgcgcggagttggatgcacacctgggccaggaactgcgggttcgggatgtggtgttcggttcgcaagcgtggttgctggatcggacggtgtgggcgcagtcgggtttgttcgcgttgcagattggcttgctgcggctgctgggttcgtggggtgttcggccggatgtggtgttggggcactcggtgggtgagctggctgcggtgcatgcggctggtgtgttgtcgttgtcggaggccgcgcggttggtggcgggtcgcgcccggttgatgcaggcgttgccttctggtggtgccatgctcgcggtcgctacgggtgagtttcaggtcgatcctctgctggatggggtgcgggaccggatcggtatcgcggcggtgaatggcccggaatcggttgtgctctctggtgaccgcgagctgctcaccgagatcgctgatcggttgcacgatcaggggtgccggacccggtggttgcgggtgtcgcatgctttccattcgccccatatggagccgatgctggaggagttcgcccagatctcccgaggccgcgaatatcacgcaccggaactgccgatcatctcgaccctgatcggtgagctggacggtggtcgagtgatgggcactcccgagtactgggtgcgtcaggtgcgtgagcccgtccgtttcgccgagggtgtccaggcgcttgtcggtcagggtgtcggcacgattgtcgaattgggtccggacggggcgttgtcgacgttggtcgaggagtgtgtggcggaatccgggcgggtggccgggatcccgctgatgcgcaaggaccgcgacgaggcgcgaaccgtgctggcagctttggcgcagatccacacccgtggtggtgaggtggactggcggtcgtttttcgccggtaccggggcgaagcaagtcgacctgcccacctacgccttccagcggcagcggtactggctggcatccaccgggcgtgcgggtgacgtgaccgccgccggattggccgaggcggaccatccgctgctcggtgcggtggttgcgttggcagacggcgaaggtgtggtgctgaccggtcggttgacagcgggttcgcatccgtggttgtccgatcaccgggtgctgggcgaaatcgtcgtccccggcaccgcgatcgtcgagctggtgtggcacgtcggcgagcgcctcggttgtggccgggtggaagaactggctttggaagcgcccctgatcctgccggatcatggagcggtccaggttcaggtgctggtgggaccgcccggggaatccggagcccggtcggtggcgctctactcctgtcctggcgaggcgatcgaacccgagtggaagaagcacgcgacgggcgtgcttctcccacccgtggccgccgagaaccatgagctgaccgcatggcccccggagaatgcgaccgaaatcgatgcagacggggtctacgcattccttgaagggcacggtttcgcgtacggaccggcctttagatgtctgcgcggtgcctggcgacgaggcggggaggtgttcgccgaagtcgcattgccggatgacatgcaggcgggggtcgatcgattcggcgtccaccccgcgttgctggacgcggttctgcatgccgccgcagccgagacgtcggtggtccagagcgaagcgcgggtgccgttctcgtggcgtggggtggaacttcgcgccactgaaagcgcggtggtgcgggcgcgcctctcgttgacttcggatgacgaactgtcgttggtcgcagtggacccggctggccgattcgtggccacggttgattcgctggtgacccgaccgatctcccggcagcaggtgaggtctggcgcgatcggtgattgcctgttcgaggtggagtggcaccggaaggcgttgttgggaacaaccgccggcgacgaccttgccatcgtcggtgacggtcccagttggccggaatcggtgcgcgcaaccgcacggttcgcgaccctggatgagttccgtgcggccgtggactcggacgttcctgccccgggttcggtgttggtcgcagctatgtcggccgaagaggtcgagggtggatccctgccgtcgcgcgcccaagagtcgacctccgatctgctggctctcgtgcagtcgtggcttgcggacgagcggttcgccgaatcccagctcgtggtcgtcacgcgtgcagcggtgtcggccgactcggattcggacgtcgcggacctggtgggtgcgtcgtcgtgggggttgttgagttcagcccagtcggagaacccgggtcgcttcgtgctggtggacgtggacggcacacctgagtcgtggcaggcgttgccggccgccgtgcgagcaggagaaccgcagctggcacttcggcgcggcgtggcgctggtgcctcggttggcgcgactcacggtgcgcgaggagggctcctccccgcaactcgacacggacgggaccgtcctcatcacgggtggcaccggtgcgttggggggagtggttgcccgtcacctggtggaggagcacgggattcggcgtttggtgttggcaggccggcgtggctggaatgcgcctggagtccacgagttggtggatgagctggcgcgcgcgggcgccgtggttgaggtggtggcttgcgatgtggctgaccgcaccgatctggagcacgtgctggccgccattccggtcgactggccgctgcgggggatcgtgcataccgctggggtgctggccgacggagtgatcgggtccttgtcggcggcggatgtgggcacggtgtttgccccgaaggtgacgggggcatggcatctgcacgagttgacccgcgatctggatctgtcgttcttcgttcttttctcttccttctccgggattgcgggtgccgcagggcaggccaactacgcggcggcgaacacgttcctggatgcattggcgcgttatcgccgggcgcgtgggctgcctgggttgtcgttggcgtggggactgtgggcgcaacccagcggtatgacgagtggcttggacgcggcgtcggtggagcggttggcgcggacgggcatcgcagaactttccacggaggatggactccgcctgttcgatgccgcgttcgcgaaggaccgggcttgcgtcgttgccgctcgattggacagggcgctgctggtcgggaacggacgatcgcacgcgattccggcgctgttgagcgcgttggttcctgttcgcggcggtgtggcgaggaaaacagccaattctcaggccgcggatgaggacgcactgttgggtttggtgcgggagcacgtttcggccgtgctgggttattcgggtgcggtcgaggttgggggcgaccgtgctttccgtgatctgggttttgattcgttgtctggcgtggagttgcggaaccgccttgccggggtgctgggggtgcggttgccggcgactgcggtgttcgactatccgacgccgcgggcgctggcgcgtttcctgcatcaggaactggcaggcgaggtcgcgtccacgtcgacgccggtgaccagggcagcgagtgccgaagaggatcttgttgcgattgtcgggatgggatgtcgttttccgggtggggtgtcgtcgccggaggagctttggcggctggtggccggcggcgtggatgcggtggctgggttcccagacgatcgcggctgggatctcgcggcgttgtacgatcctgatcccgatcgtctcgggacctcgtatgtgtgtgagggcgggtttctgcgggacgcggcggagttcgatgctgacatgttcggcatcagcccgcgtgaggcgttggcgatggatccgcagcagcggttgctgctggaggtcgcctgggaaaccttggagcgggctgggatcgatccgttctcgttgcacggcagccggaccggtgtgttcgcgggcttgatgtaccacgactatggggcccgattcattaccagagcaccggagggcttcgaagggcacctcgggacgggcaatgcggggagcgtgctgtcgggtcgggttgcgtattcgtttggtttcgagggtcctgcggtgacggtggatacggcgtgttcgtcgtcgttggtggcgttacacctggcgggtcaagcactgcgggccggtgagtgcgaattcgcccttgccggtggcgtcacggtgatgtcgacgccgacgacgttcgtggagttctcccgtcaacggggtctggctccggatgggcggtgcaagtcgttcgcggcggccgcggatggcaccgggtggggcgagggtgccggtctggtgttgctggagcggttgtcggatgcccggcgcaatgggcacgaggttctggcggtggtgcggggtagcgcggtgaaccaggacggcgcgtcgaatggcttgactgcgccaaatggtccgtcacagcaaagggtgatcacccaggcactcacgagtgccgggctgtccgtgtccgacgtggatgctgtggaggcgcatgggacgggcacgcggcttggtgatccgatcgaggcgcaggcgttgatcgctacgtacggccgggatcgtgatcccggtcggccgttgtggctggggtcggtgaagtcgaatattggtcacacccaggcggcggcgggtgtcgctggtgtgatcaagatggtgatggcgatgcggcagggggagctgccgcgcacgttgcacgtggacgagccctccgcgcaggtggactggtctgcgggcacggtccaactcctcacggagaacacgccctggcccgacagcggtcgtcttcgccgggcgggcgtgtcatcgttcgggatcagtggcaccaacgcgcacctgatccttgaacaacctccgcgagagtcgcagcgctcaacagagccggattcgggttctgtccgcgattttccggtggtgccgtggatggtgtcgggcaaaacacccgaagcgctatccgcccaggcagatgcattgatgtcctacttgagcaatcgcgttgatgcttccccgcgagatatcggttattcgcttgcggtgacccgtccggcgttggaccaccgcgctgtcgtgctgggtgcggatcgtgccgcgttgctgccgggcttgaaagcgctggccgttagtaatgacgctgccgaggtgatcaccggcactcgtgccgctgggccggtcggattcgtgttctccggtcaaggtggtcagtggcccgggatgggaagcgggctccactcggcgtttccggtgttcgccgacgcgtttgacgaagcctgctgcgagctggatgcgcatctcgggcagatggcccggctacgagatgtgttgtccggttcggatacgcaacttctggaccagaccttgtgggcgcagccgggcctgttcgcgttgcaagtcggactctgggagttgttgggttcgtggggtgtccggcccgctgtggtgctgggccactcggtcggtgagctggcggcggcgttcgcggctggagtgttgtcgttgcgggatgcggctcggctggtggcgggccgtgcccggttgatgcaagccctgccaactggcggtgccatgctcgctgcggctgctggagaggagcagctgcgcccgttgctggccgactgcggtgatcgtgtggggatcgccgcggtcaacgctcccgggtcggtggtgctctccggtgatcgggatgtgctcgatgacattgccggtcggctggacgggcaagggatccggtccaggtggttgcgggtttcgcatgcgtttcattcgcatcggatggatccgatgctggcggagttcaccgaaatcgcccggagcgtggactaccggtcgtcagggctgccgatcgtgtcgacgttgacgggtgagctcgatgaggtcggcatgccggctacgccggagtattgggtgcgccaggtgcgagaacccgtccgcttcgccgacggtgttgctgcgctcgcggctcacggtgtgagcaccgtcgtcgaggtcggtccggatggggtgttgtcggcgctggtgcaggagtgcgcggccggatccgatcagggcggacgggtggccgcggttccgctcatgcgcagcaatcgcgacgaggcgcacacggtgacaacggcattggcgcagatccatgtgcgtggtgctgaggtggactggcggtcgtttttcgccggtaccggggcaaagcaggtcgagctgcccacgtatgccttccaacgacagcggtactggcttgactcaccatccgaaccggtcgggcaatccgccgatcccgcgcgccagtcgggcttctgggaactcgtcgagcaggaagatgtcagcgcgctcagcgccgctctgcacattaccggcgatcacgacgtgcaggcgtccctggaatcggtggttccggtcctctcctcctggcatcgccggatccgcaacgaatccctggtgcaccagtggcggtaccggatttcctggcatgagcgggcagatttgccagacccctcgttgtcggggacatggctcgtcgtcgtgccggaggggtggtcggcgagtcggcaagttctgcgtttcaacgagatgttcgaggaacggggttgcccggcagttctgttcgagctcgccgggcacgacgaggaagccctggcgcaacgattccgctcgttgcctgttgcgtcagggggaataagcggcgtgttgtccttgctggcgctggatgaatcgccgtcctcgccgaacgctgctttgccgaatggcgcgctgaactcgttggtactgctgcgagctctgcgggccgcggatgtgtcggcgccattgtggttggcgacgtgtggtggtgtcgcggtcggggatgtgccggtgaacccggggcaggcgctggtgtggggactgggtcgcgtcgtcggtctggagcatccggcctggtggggtggcctggtcgacgtgccgtgcttgctcgatgaggacgctcgagaacgcttgtcggtcgtgttggcaggtcttggcgaggacgagatcgcggtacgtcccggtggtgtgttcgtgcggcggttggaacgcgctggtgcggcgtcgggtgccgggtcggtgtggcgtcctcgggggacggtgttggtgacgggtggtacgggcggtttgggggcgcatgttgcccggtggttggcgggtgccggggctgagcatgtggtgttgaccagccgtcgaggcgcggcggctccgggcgctggagatttgcgggcggagctggaggcgctgggcgctcgggtttcgatcacggcctgcgacgtggccgatcgtgacgctttggccgaagtgttggcgaccattccggatgattgcccgctgaccgcggtgatgcatgcggcgggggtcgttgaagtcggcgacgtggcgtcgatgtgtttgaccgacttcgttggggtgctgtcggcgaaggcaggtggtgcggcgaatctcgatgagttgctcgccgatgtcgagctggatgccttcgtgctgttctcatccgtctcgggtgtgtggggtgctggcgggcagggcgcttatgcggcggcgaatgcctacttggatgcgttggcgcagcagcgtcgggcaagggggttggtggggactgcggttgcgtggggcccgtgggccggtgacggaatggccgcaggtgaaggcggtgcacagctgcgccgggccggcctggtgccaatggctgcggatcgggcgttgctggcacttcagggcgcattggatcgtgacgagacatccctggtcgtggccgatatggcgtgggagaggttcgccccggtgttcgccatgtcccgtcggcgtccgctgctcgacgagctgcccgaagcacagcaggcgttggcggatgcggagaacaccactgatgctgcggactcggccgtcccgctaccgcggctcgcgggcatggcagccgccgaacgccgccgcgcgatgctggacctggtgctggcggaggcctcgattgtgttgggacacaacgggtctgacccagttggtcccgaccgggcgttccaggagctcggatttgattcgctgatggccgtcgaactgcgcaacaggttgggcgaggcaacaggattgagtctgccggccacgttgatcttcgattatccgagcccatccgcgctggctgagcagctggtcggcgagctggtgggagcgcagcccgcgaccaccgtcgtggccggggccgatccagtggatgatccggttgtcgtggtcgcgatgggatgccggtatccgggcgacgtctgctcgcccgaggagctgtggcagctggtttctgcgggacgtgatgcggtatcgacgttccccgtcgatcggggttgggactgcaacacgttgttcgacccggatccggatcgggcaggcagtacctatgtgcgagaaggtgccttcctgaccggtgctgatcggttcgacgccgggttcttcggcatcagccctcgcgaggcgcgcgcaatggatccgcagcagaggttgttgctcgaagtggcgtgggaggttttcgaacgagcaggaatcgctccgctgtcgttgcggggtagcaggaccggtgtgttcgcggggaccaatgggcaggaccacggtgcgaaagtggctgccgcgccggaggcggcgggtcacctcctgaccggaaacgccgcgagtgtcctggccggccggctttcctacacgttcggccttgaggggcctgcggtggcggtggataccgcgtgttcgtcgtcgttggtggcgttgcatttggcgtgccagtcgctgcgttcgggtgagtgtgatatggcgttggcaggtggtgtgacggtgatgtcgacacccctggctttcctcgagttctctcgtcagcgcggtttggcgccagatggtcggtgcaagtcgtttgcggccgctgcggatggcaccgggtggggtgagggtgccggcctggtgttgctggagcggttgtcggatgctcgtcggaatggtcaccgggtgttggccgtggttcgcgggtctgcggtgaatcaggatggtgcgtcgaatggcctgactgcgccgaatggtccgtcgcagcagcgggtgattcggcaggccctcgcgaatgcggggctgtcggcgtccgatgtggatgtcgtggaggcgcacgggaccggtaccgggctcggggatccgatcgaggcgcaggcgctgatcgcgacatatgggcaggagcgggatcctgagcgggccctgtggctggggtcgatcaagtccaacatcggccacacgcaggcggcggccggtgtggcgggggtcatcaagatggtgcaggccatgcggcacggggagttgcctgcgacgttgcacgtggacaagcccactccacaggtggactggtctgccggggccgttcggctcctcaccgggaacacgccctggcccgagagcggccgtcctcgtcgagcgggggtgtcgtcgttcgggatcagcggcaccaacgcacacctcatcctcgaacaaccaccgtcggaaccagcggagatcgaccaatcggatcggcgggtcactgcgcatccagcggtgatcccgtggatgttgtcggctaggagtctcgcagcgctgcaggcccaagcggctgcgctgcaggcccggctggaccggggtcctggcgcttctccgctggatttggggtattcactcgcgaccactcgttctgtgctggacgaacgcgccgtcgtgtggggtgccgatcgggaggcactgctgtccaggctggcagcgctcgccgatggccggacggcgccgggggtgataacgggctctgcgaattccggtggccgcatcggattcgttttttccggtcagggcagtcagtggctggggatgggaaaggcgttgtgcgcggctttcccggcgttcgcggacgccttcgaggaagcctgcgacgcgctaagcgcacacctgggcgcggacgttcggggtgtgctgttcggtgctgatgagcagatgctcgaccggacgctgtgggcgcagtcggggatcttcgcggttcaagtcggcctcctgggattgctgaggtcgtggggcgtgcggccggccgcggtgctggggcactcggtcggcgagttggctgcggcgcacgcggctggtgtgttgtccttgccggacgctgcacggttggttgcggctcgggcccacctgatgcaggcattgcccaccggcggcgcaatgctcgcggtcgccaccagcgaggcggcggtcggaccgctgctttccggggtgtgcgatcgggtcagcatcgctgcgatcaacggccccgagtcggtagtgctctccggcgaccgcgatgtgctcgtggagctcgcaggcgaattcgatgcccgagggcttaggaccaaatggttgcgggtctcccatgctttccactcgcaccggatggaaccgattctggacgagtacgcggaaaccgccaggtgcgtcgagttcggtgaaccggtggtgccgatcgtctccgccgcgaccggtgcgctggacaccaccggactgatgtgcgcggccgactactggacgcgccaagtgcgtgatcctgtccgcttcggagacggtgtccgggcgctcgtcggccaaggcgtggacacgatcgtcgagttcggcccggacggggcgttgtcggccctggtcgagcagtgcttggccgggtccgaccaggctgggagggtggcggcgatcccgctgatgcgcagggaccgcgatgaggtcgagaccgcggtggcggccctggcgcacgtgcacgtccgcggtggtgcggtggactggtcggcttgcttcgccggcaccggcgcccgcaccgtcgagttgcccacctacgccttccaacgccagcggtactggctggccgggcaagcggacgggcgcggcggcgatgtggttgccgacccggtcgacgcgcgcttctgggagttggtcgagcgcgccgatccggaaccgttggtggatgaactctgcatcgaccgggaccagcccttccgggaggtgctgcccgttctggcttcctggcgcgagaaacaacgccaggaggccctcgcggattcctggcgctaccaggtgcgctggaggtccgtcgaggtgccgtccgcagccgccctccggggcgtgtggctggtggtgcttccagctgacgtgccccgagatcaaccggcggtcgtcatcgacgcgctgatcgcgcgcggcgccgaggtcgcggtcctggaattgaccgagcaggacctccaacgcagtgcgcttgtggacaaggtgcgcgccgtcattgcggaccgcaccgaggtgacgggtgtgttgtctctgttggcgatggacggcatgccctgcgcggcgcatccgcacctgtcccgtggtgtcgccgctaccgtgatcctgacgcaggtgttgggcgatgcgggtgtttccgccccgctgtggctggccacgaccggtggcgtcgaggccgggaccgaggacggtccggccgatccggaccacggcttgatctgggggctcggcagggtcgtcggccttgaacatccgcagtggtggggtggcctgatcgaccttccggagacactggacgagacgtcccggaacgggttggtggccgcactcgccgggacggcggccgaagatcagctcgccgtgcgttcatccgggttgttcgttcgcagagtggtgcgcgcagcgcggaacccccggtcagagacatggcgtagccggggaacggtcctcatcacgggcggaacaggcgcgctcggtgccgaggtcgcacgatggctggcccggcggggagctgagcacctggtgttgatcagtcgccgcggcccggaagctcccggcgcagcggacctaggggccgagctgactgaactcggcgtgaaagtcacagtcttggcctgcgatgtgacggaccgcgacgagctggcggcggtgctggcggccgttcccacggagtatccgctgtcggcggtcgtgcacaccgccggcgtcgggacgcctgcgaacctggccgagacgaccttggcgcagttcgccgacgtgttgtcggccaaggtcgtcggcgcggcgaacctggaccggctgcttggcgggcaaccgttggacgccttcgtgctgttctcctcgatctcgggagtttggggagccggcggccaaggagcctattcggccgccaatgcgtatctcgatgcccttgccgagcgccgacgggcttgcgggcggccggcgacgtgcatcgcctggggtccgtgggcgggtgcgggcatggccgttcaggaaggtaacgaggcgcatctccgccgaaggggcctggtaccgatggaaccgcagtcggccctcttcgcgctgcaacaggccctgtcccaacgagaaaccgccatcaccgtcgcagatgtggactgggagcgattcgccgcctctttcaccgcggcccgcccgcgaccactgttggaagagatcgtggatctacggcccgacaccgagaccgaggagaagcacggtgccggcgagctggggcagcagctggccgcactgccgcccgctgagcgcggacacctgctgctggaggtggtgctggcggaaaccgccagcaccctggggcacgattcggcggaggctgtgcaacccgatcggaccttcgccgaactgggcttcgattcgctgaccgcggtagagctgcgcaacaggttgaacgcggtgaccgggcttcgcctgccgccgacgctggttttcgaccacccgacgccgctggcgttgtccgaacagttggttccggccctggtcgcggagccggacaacggcatcgaatcgctgctcgccgagctcgacaggctggataccacgttggcgcaagggccttcgatcccactggaagaccaggccaaggtggcggagcgcttgcacgcactcctcgccaagtgggacggggcgcgtgacggcacggccagagcgacgtcaccccaatcgctgacggcggccacggacgacgaaatcttcgacctcatcgaccggaagttccggcgctgaccgccctttcctcgcctcagctcccctgattactggaacggtgtatttcgatggccaatgaagaaaagctccgcgagtacctcaagcgtgtcgtcgtcgaactggaagaggcgcacgaacgcctgcacgagttggagcgccaggagcacgaccccatcgcgatcgtgtcgatgggatgtcgttatcccggtggcgtctccactccggaggagctgtggcgactggtcgtcgacggaggagacgcgatcgcgaacttccccgaagaccgtggctggaatctggacgagctgttcgatcctgatccgggccgagccgggacctcctacgtccgcgagggtggtttcctgcgcggggtcgcggacttcgatgccgggctcttcgggatcagtccgcgcgaggcacaggcgatggacccgcaacagcggttgctgctggagatctcgtgggaggtgttcgagcgcgccggcattgacccgttttctttgcggggtaccaagaccggtgtgttcgcgggcctgatctaccacgactacgcgtcgcggtttcgcaagacccccgcggagttcgagggttacttcgccaccggcaacgcgggcagcgtcgcatccggccgggtggcttacaccttcgggttagagggcccggcggtcaccgtggacaccgcctgctcgtcgtccctggtggcgctgcacctggcctgccagtccctgcggctgggcgaatgcgacctggccctggccggtggcatttcggtgatggccacgccgggagccttcgtcgagttcagccggcaacgcgcactcgcctcggatggccggtgcaagcccttcgcggatgccgccgacggcaccggctggggcgagggcgccggaatgctgctgctggaacggctgtcggacgcacgacgaaacggccacccggtgctggcggcggtggtcggttccgcgatcaaccaggacgggacgtccaacggcctgaccgcgcccagcggtcccgcacagcagcgagtgatccgccaagccctggcgaacgccgggttgtcgcccgccgaggtcgatgtggtcgaggcgcacggcacgggcacggccttgggcgacccgatcgaggcgcaggccctgatcgccacctacggggcgaaccggtcggcggatcatccgctgctgctgggttccctcaagtcgaacatcggccacacccaggctgccgccggtgtggccggggtgatcaagtcggtcctggccatcaggcaccgggagatgccccgcagcctgcacatcgaccagccatcgcagcacgtggactggtcggcgggcgcggtgcggctgctcacggacagcgttgactggccggatctcggcaggccgcgccgagcaggggtgtcctcgttcggcatgagcggtaccaacgcacacctgatcgtcgaggaagtatccgacgagccggtctcgggcagtaccgagccgaccggggcatttccctggccgctgtccggcaagacggagacggcattgcgcgagcaggctgccgagttgctctccgtagtgaccgagcacccggagccgggactgggggacgtcgggtactcgctggccaccggtcgcgctgcgatggagcaccgggctgtcgtggttgccgacgatcgggactctttcgtcgccggactgacggcgttggctgcgggcgttccggcagccaacgtggtgcagggcgcggccgactgcaagggaaaggtcgcgttcgtgttccccggccagggctcgcattggcaggggatggcgagggaactgtccgaatcctcgccggtgttccggcggaagctggcggaatgcgcggcggctacggccccttacgtggactggtcgctgctcggcgtccttcgcggtgatcccgatgcacccgcgctggatcgcgacgacgtgattcagctcgcgctgttcgccatgatggtgtcgctggccgaactgtggcgttcgtgcggagtggagcccgccgcggtggtcggtcattcccagggcgagatcgccgccgcccatgtggcaggcgctttgtccttgactgatgcggtgcgcatcatcgctgcccgctgcgatgcggtgtcggcgctgaccgggaagggaggcatgctcgcgattgccttgccggaaagcgcggtggtgaagcgaatcgcaggcctgccggagctgaccgttgcggcggtcaacggacccggctccactgtcgtttccggcgaaccgtcggctctggagcgtctgcagaccgaactgaccgcggaaaacgtgcagacccggcgggtgggaattgattacgcctcgcattcgccgcagatcgcgcaggtccagggccggcttctggaccggctgggcgaagtcgggtccgaacctgctgagatcgctttctactcgacggtcaccggcgagcggacggacaccggccgactcgacgccgactactggtaccagaaccttcggcagcccgtccgcttccagcagaccgtcgcccggatggcagatcagggctatcggttcttcgtcgaggtgagcccgcacccgctgctcaccgccggaatccaggaaacgctggaagccgcggacgcgggcggggtggtggtcggttcgctgcggcgtggcgagggcggctcccggcgctggctgacttcgctggccgagtgccaggtgcgcggactgccggtgaattgggaacaggtattcctcaacaccggagcccgacgcgtgccgctgccgacctacccgttccagcggcagcggtactggttggagtccgccgagtacgacgcgggcgatctcggttcggtgggcttgctctccgccgagcatcccctgctcggggctgcggtgacgctggccgatgcgggcgggttcctgctgaccggcaagctgtcggtcaagacccagccctggttggccgaccacgtggtcggcggggcgatcctgctgcccggcaccgcgttcgtggaaatgctgatacgcgccgcggaccaggtcgggtgcgatctgatcgaggagttgtccctgacgactccgctggttttgcccgcgaccggtgcggtgcaggtgcagatcgcggttggcggtccggacgaggccgggcgccgctcggtccgcgtgcattcctgtcgagacgacgccgtgccgcaggactcgtggacctgccacgcgaccggcacgttgacctccagcgatcaccaggacgccggccagggccccgatgggatttggccgcccaacgatgctgtcgcggttccgctggacagcttctacgcccgcgcagctgagcggggcttcgatttcggcccggcgttccaggggttgcaggcggcttggaagcgcggagacgagatcttcgccgaggtcggcctgcccaccgcacaccgcgaagacgccggcaggttcggaatccaccctgctctgctggatgcggcactgcaggcgctgggcgcagccgaagaggatccggacgagggatggctcccgttcgcgtggcaaggtgtgtccctcaaagcgacgggcgcactttcccttcgggtgcacctcgttccggcgggcgcgaatgcggtgtcggtgttcacgaccgacacgactggccaagccgtgctctccatcgattcgctggtgctgcgccagatttcggacaagcagttggcagcggcccgtgcgatggaacacgagtccctgttccgggtcgactggaagcgaatctcgcccggcgctgccaagccggtctcctgggcagtgatcggcaatgacgaactcgcccgagcctgcggctcggcacttggcacggaactccaccccgacctgaccgggttggctgacccgcccccggacgtcgtggtggtgccatgcggtgcgtctcgccaggacttggacgttgcttccgaggcacgtgccgcgacacaacgcatgcttgacctgatccaggattggttggcggcggcgcgattcgccggatctcgcctggtggttgtgacgtgtggtgcggcgtcgacaggtcccgccgagggtgtttccgacctggtgcatgctgcgtcgtggggtttgttgcgttcggcgcagtcggagaacccggaccgattcgtgttggtcgatgtggacggaaccgccgaatcatggcgtgcgctcgcggcggccgtgcgttccggagaaccgcagctggcgttgcgcgccggtgaagtccgggtgcctcgcctggcgcgatgtgttgccgccgaggacagccggatcccagtgcccggtgcggatgggacggtgttgatttccggcggtacgggcctgctgggcgggttggttgcccggcatttggtggcggagcgcggtgtccgccgcctggtgctcgcggggcgacgcggctggagcgcccccggggtcaccgacctggtggatgagttggtgggcctgggagctgcggtcgaggtggcgagctgcgatgtcggggatcgggcccagttggaccggctgctgacgacgatctcggcagagttcccgctgcgcggagtggtgcatgcggccggggcacttgccgacggggtcgtcgagtcgctgacaccagagcacgtggcaaaggtgttcggcccgaaggccgccggtgcgtggcacctgcacgagttgactcttgatctggatctctcgttcttcgtgctcttctcctcgttctccggcgtggcgggggctgcgggtcagggaaactacgcggcggcgaacgcgttcctggacggcctggctcagcaccggcggacggcggggctgcctgcggtgtcgctggcttggggcttgtgggagcagcccagcgggatgaccggagcgctcgatgcggcgggccgtagccgcattgcgcgcaccaatccgccgatgtccgcgccggacgggttgcggctgttcgagatggcgtttcgcgttccgggcgaatcgcttctggttccggtccacgtcgacctgaacgccctgcgcgctgatgcggccgacggcggtgtgcctgcgttgttgcgcgacctggtgccagcgcccgtgcggcggagcgcggtcaacgagtcggcggacgtcaacggtctggttggtcggctgcggaggctgccggacctggatcaggaaacccagctgttgggtttggtgcgcgagcatgtttcggcggtgctggggcattcgggtgcggtcgaggtcggggccgatcgtgctttccgggatttgggttttgattcgttgtccggtgtggagtttcggaaccggcttggcggggtgctgggcgttcggttgccggctactgcggtgttcgactatccgacaccgcgggcgttggttcggttcttgctcgacaaactgattggtggcgtggaggctccgactcccgcaccggcggctgtggcggcggtgactgctgacgatcccgttgtgatcgtggggatgggctgtcgttatccgggtggggtgtcctcgccggaggagctttggcgtttggtggccgggggcttggatgcggtggcggagttcccggacgatcgtggctgggatcaggcggggttgttcgatccggatcccgatcgtcttgggacctcgtatgtgtgtgagggtggcttcctgcgagatgcggcagagttcgatgccggtttcttcgggatttccccgcgtgaggcgttggcgatggatccgcagcagcggttgctgctggaagtcgcttgggaaaccgtggagcgggcggggattgatccgctttcgttgcgggggagccggaccggcgtgttcgcggggctgatgcaccacgactacggcgcgcggttcatcacgagggcgccggagggtttcgagggttatctaggtaatggcagcgcgggaggcgtgttttcgggtcgggttgcgtattcgtttggtttcgagggtcctgcggtgacggtggatacggcgtgttcgtcgtcgttggtggcgctgcacctggcgggtcaagcactgcggtctggtgagtgtgatctggctcttgcgggtggtgtgacggtgatggccacgccggggatgttcgtggagttttcgcgtcaacggggcttggcggcggatgggcggtgcaagtcgtttgcggcggctgcggatggcaccggttggggagaaggcgcgggcttggtgttgttggagcggctgtcggatgcccggcgcaacgggcacgcggttctggcggtcgtgcggggtagcgcggtgaatcaggatggtgcgtcgaatggtttgacggcgccgaatgggccctcgcagcagcgggtgatcacgcaggcgttggcgagtgctggtttgtcggtgtctgatgtggacgccgtggaggcgcatgggactggaaccaggcttggtgatccgattgaggcgcaggctctgattgccacttacgggcaggggcgggatagcgatcggccgttgtggttggggtcggtgaagtcgaatattggtcatacgcaggcggcggcgggtgtcgctggtgtgatcaagatggtgatggcgatgcggcacgggcagctgcccgcgacgttgcatgtggatgaacctacgtcggaagtggattggtcggcgggggatgtccagctcctcacggagaacaccccctggcccggcaacagccatcctcggcgggtgggcgtgtcgtcgttcgggatcagcggcaccaacgcacacgtcatcctcgaacaagcctcgaaaacaccagacgagactgcggacaagagcggtcccgattcggaatcgaccgtggaccttccagcggtcccgttgatcgtgtcggggagaacaccggcagcgctcagcgctcaggcgagcgcattgttgtcctatttgggtgagcgtggcgatatttccacgctggatgcggcgttttcgttggcttcctcccgggccgcgttggaggagcgggcggtggtgctgggagcggaccgcgaaacgttgttgtccgggttggaagcgctggcttccggtcgcgaggcttctggggtggtgtcgggatccccggtctctggcggggttgggttcgtgttcgccggtcagggcggacagtggttggggatgggccgggggctctactcggtttttccggtgttcgctgacgcgtttgacgaagcatgtgccggactggacgcgcatctggggcaggacgtgggggtccgggatgtggtgtttggttccgacgggtccttgttggatcggacgctgtgggcccagtcgggtttgttcgcgttgcaggttggtttgctgagcctgctgggttcgtggggtgtccggccgggtgtggtgctgggccattcggtcggcgagttcgcggcggcggttgcggcgggagtgttgtcgttgccggatgcggctcggatggtggcgggtcgtgcccggttgatgcaggcgttgccttctggcggtgccatgttggcggtggctgctggtgaggagcagctgcggccgttgttggccgatcgggttgatggtgcgggtatcgccgcggtcaacgctcctgagtcggtggtgctctccggcgatcgggaggtgcttgacgacatcgccggcgcgctggatgggcaagggattcggtggcggcggttgcgggtttcgcatgcgtttcattcgtatcggatggacccgatgttgcaggagttcgccgaaatcgcacgcagcgtggactaccggcgtggcgacctaccggtcgtgtcgacgttgacgggtgagctcgacaccgcaggtgtgatggctacgccggagtattgggtgcgtcaggttcgagagcccgtccgcttcgccgacggcgtccgggtgctcgcgcagcaaggggtcgccacgatcttcgaactcggccctgatgcgacgctgtcggccctgattcccgattgtcattcgtgggctgatcaggccatgccgattccgatgctgcgtaaagaccgtacggaaaccgaaactgtggtcgccgcggtggcgcgggcgcacacgcgtggtgttccggtcgaatggtcggcgtatttcgccggcaccggggcacggcgggtcgagttgccgacgtatgccttccagcggcagcggtactggctggaaacatcggattacggcgatgtgacgggtatcggcctggctgcggcggagcatccgttgctgggggccgtggttgcgctggccgatggtgatgggatggtgctgaccggccggttgtcggtggggacgcatccgtggctggcccagcatcgcgtgctgggcgaggtcgtcgtccccggcaccgccatcctggagatggccctgcacgcaggggcgcgtctcggctgtgaccgggtggaagagctcaccctggaaacaccgctggtggtccccgaacgcgcggcgggtgccggtagtcgtggccctgcgggagggaccacagtttcaattgaaactgcggaagaacgtgtgcggacgaacgacgccatcgaaatccagctgctggtgaacgcacccgacgaaggcggtcggcgaagggtgtcgctgtattcccgcccggccggtgggtcgagaggtgggggttggacgcgccacgccaccggcgaactcgtcgtcggcaccaccggtggtagggcggttcctgattggtcggctgagggtgccgagtcgattgctctcgatgagttctacgtcgctctggccggaaacgggttcgagtacgggccgttgttccaggggcttcaggcggcatggcgtcgtggtgacgaggttctcgccgaaatcgccccgccggccgaggccgatgcgatggcgtcgggatacctgctcgacccagcgttgctggatgccgcgctgcaggcgtccgcgctcggcgaccgcccggagcaaggcggcgcgtggctgccgttctcattcaccggcgtcgaactttccgctccggcagggacgatcagcagggtgcggctggagaccaggcgacccgacgcgatatcggtggccgtgatggatgagagtgggcggttgctcgcctcgatcgattctctcaggctacgaagcgtgtcgtcgggacagctggcgaatcgggacgctgtccgcgacgcgctgttcgaggtgacctgggagccggtggcgacgcagtcgacggaaccgggtcgctgggccctgcttggtgatactgcctgcggtaaagacgatctcatcaaactcgcaacggattccgccgaccgctgcgcggatctggcggcgctagccgagaaacttgattccagcgcgctggttcctgatgtcgtggtctactgcgccggagaacaggcggatcccggcaccggcgcagccgcacttgcggagacccagcagacgttggctctgctccaagcgtggttggctgagccgcggttggccgaggcacgtctggtggtggtgacgtgtgcagcggtgacgacggctccgagtgacggtgcatcagagctggcacatgcgccgttgtgggggttgttgcgtgccgcgcaggtggagaacccggggcagtttgtgctggcggacgtcgacggaaccgccgaatcgtggcgtgcgttgccgagtgcgttgggctcgatggaaccgcagttggccctgcggaagggcgcggtgcgagcgccccgcttggcttcggtcgccgggcagatcgacgtgcccgcggttgtggcggatcccgaccgaaccgtgctgatttcgggcggcacgggcctgttggggggcgcggttgcccgccacctggtgaccgaacgcggtgtccgccgattggtgttgacgggccgtcgtggctgggatgctcctggaatcaccgagttggtgggtgagctgaacggcctcggtgccgtggtcgacgtggtggcgtgcgacgtcgcggatcgtgctgatctggagtcgttgctggcggcggtcccggcggaatttccgttgtgcggcgtggtgcatgccgcgggggcgctggccgacggggtgatcgagtcgttgtcaccggacgacgtgggagcggtgttcggcccgaaggcggcgggggcgtggaatctgcacgagctgactcgtgatacggacctgtcgttcttcgcgttgttctcctcgctttccggtgttgccggcgctcctggtcagggcaattatgcggcggcgaacgcgttcctggacgcattggcgcattaccggcggtcacagggactgcctgcggtgtcgctggcctggggcctgtgggagcagccgagcgggatgacggagacgctcagcgaggtcgaccggagcaggatcgcgcgcgccaacccgccgttgtccaccaaggagggattgcggctgttcgatgccgggctggcgctggaccgggcagcggtagttccggcgaagttggacaggactttcctggccgagcaggcgcggtcgggctcgctgcccgcattgttgacggcactggtaccccccatccgtcgtaataggcgggctagcggaaccgagctcgcggacgagggcaccctgctcggggtggtgcgggagcatgccgcggccgtgctggggtattcgagcgcggctgacgtcggggtcgagcgcgctttccgggatctgggttttgattcgttgtctggtgtggagttgcggaaccgccttgccggggtgctgggggtgcggttgccggcgactgcggtgttcgactatccgacgccgagggcgctggcccggttcctgcaccaggaactggcagacgagatcgctacgacgccagcgccggtgacgacgaccagggcaccggtcgccgaagacgatctcgtcgcgatagtcgggatgggatgccgttttcccggtcaggtgtcctcgccggaggagctctggcgtttggtggccgggggcgtggatgcggtcgcggacttcccagccgatcgcggctgggatctggcaggcttgttcgatccggacccggaacgggctgggaagacctacgtgcgggaaggggccttcctcaccgacgccgatcggttcgatgcgggtttcttcgggatttccccgcgtgaggcgttggcgatggatccgcagcaacggctgttgctggagctgtcctgggaggccattgaacgggcagggatcgatccgggttcgctgagggggagtcggaccggtgtgttcgcggggctgatgtaccacgactatggcgcccggttcgccagccgagccccggaaggtttcgaggggtatctcggcaatggcagtgctgggagtgtcgcgtcgggccggattgcgtactcgtttggtttcgagggtcctgcggtgacggtggatactgcgtgttcgtcgtcgttggtggcgttgcatttggcgggtcagtcgttgcgttccggcgaatgcgatctcgcccttgccggtggtgtgacggtgatgtcgacgcccgggacgtttgtggaattctcccgtcagcggggcctggcaccggacgggcggtgcaagtcgttcgcggagagcgcggacggtaccggttggggtgagggtgctggtttggtgttgttggagcggttgtcggatgctcggcggaatgggcatcgggtgttggcggtggttcgtgggtcggcggtgaatcaggatggtgcgtcgaatggcttgaccgcgccgaatggtccctcgcagcagcgggtcatccagcaggcgttggcgagtgcgggtctgtcggtgtccgatgtggatgccgtggaggcgcatgggaccgggaccaggttgggtgatccgattgaggcgcaggctctgattgctacgtatgggcgcgatcgtgatcccggtcggccgttgtggttggggtcggtgaagtccaacatcggtcatacgcaggcggcggcgggtgttgccggtgtgatcaagatggtgatggcgatgcggcacgggcaacttccgcgcacgctgcacgtggatgcaccctcctcgcaggtggattggtcggcggggagggtccagctcctgacggagaacacgccctggcccgacagtggtcgcccctgtcgggtgggggtgtcgtcgttcgggatcagcggcaccaacgcgcacgtcatcctggaacagtccacggggcagatggatcaggcagcggagccggattcgagtcctgttctggatgttccggtggtgccgtgggtggtgtcgggcaaaacacccgaagcgctatccgcccaggcggcaacgttggcgacctatttggaccaaaatgttgatgtctcccctctggacgttgggatttcgcttgcggtgacccgttcggcgctggatgagcgggcggtggtgctggggtcggatcgtgacacgttgttgtctggcctgaatgcgctggctgccggtcatgaggctgctggcgtggttacgggacctgtcgggattggtggccggaccgggtttgtgttcgccggtcaaggcggtcagtggttggggatgggccgccggttgtactcggagtttccggcgttcgccggtgctttcgacgaagcatgcgccgagctcgatgcgaacctggggagggaagtcggggttcgggatgtggtgttcggctccgacgagtccttgctggatcggactttgtgggcgcagtcgggtttgttcgcgttgcaggtcggtctctgggaattgttgggtacgtggggtgttcggcccagcgtagtgctggggcattcggtcggggagctagccgcggcgttcgccgcaggtgtgctgtcgatggcggaggcggctcggctggtggcgggtcgtgcgcggttgatgcaggcgttgccttctggcggtgccatgctggcggtgtccgcgaccgaggcccgagtcggcccgctgctcgatggggtgcgggatcgtgttggtgtcgcagcggttaacgctccggggtcggtggtgctttccggtgaccgggatgtgctcgatggcattgccggtcggctggacgggcaaggtatccggtcgaggtggttgcgggtttcgcacgcgtttcattcgcatcggatggatccgatgctggcggagttcgccgagctcgcacggagcgtggactaccggtctccacggctgccgattgtctcgacgctgaccggaaacctcgatgacgtgggcgtgatggctacgccggagtattgggtgcgccaggtgcgagagcccgtccgcttcgccgacggtgtccaggcgcttgtggaccaaggcgtcgacacgattgtggaactcggtccggacggggcgttgtcgagcttggttcaagagtgtgtggcggagtccgggcgggcgacggggattccgttggtgcggagagaccgtgatgaggtccgaacggtgctggacgctttggcgcagacccacactcgtggtggcgcggtggactgggggtcatttttcgctggtacgagggcaacgcaagtcgaccttcccacgtatgccttccaacgacagcggtactggctggagccatcggattccggtgatgtgaccggtgttggcctgaccggggcggagcatccgctgttgggtgccgtggtgccggtcgcgggcggcgatgaggtgctgctgaccggcaggctgtcggtggggacgcatccgtggctggcggaacaccgcgtgctgggcgaagtcgtcgtccccggcaccgcgttgctggagatggcgtggcgggccggtagccaggtcggttgtgaacgtgtggaggagctcaccttggaggcaccgctggtcctgccggagcggggcgctgcggcggtgcagttggcggtgggggctccggatgaggccggccggcgcagtttgcagctctattcccgaggcgctgatgaagacggcgactggcggcggattgcctccgggctgttggcccaggccaatgcggtgccgccggcggattcgacggcatggccgccggacggcgccgggcaggtcgatctggcggagttctacgagcgcctcgccgagcgcggcttgacctacggtccggtattccaagggctccgcgccgcatggcggcacggcgacgatatcttcgccgaattggccgggtcaccagacgcctcgggtttcggcatccacccggcgctgctggacgctgcactgcacgcgatggcgcttggtgcttcgcccgactcggaagcgcgtctgccgttttcctggcgtggcgcccagctgtaccgcgctgaaggagcagcgcttcgggtacggctctcgccgctgggctccggtgcagtctcattgacgttggtggatgccacagggcgacgagtcgctgcggtggaatcgctttcgacgcgaccggtctccaccgaccagatcggtgccggtcgcggcgatcaagagcggctgctgcacgtcgagtgggtaaggtcggctgaatctgcggggatgtctctgacctcctgcgcggtggtcggtttgggcgaaccggagtggcacgctgcgctgaagaccactggtgtccaagtcgagtcccatgcggaccttgcttcgttggccaccgaggttgccaagcggggttcagctcctggtgcggtcatcgtcccgtgcccgcgaccccgagcgatgcaggagctgccgaccgccgcgcgaagggcgacgcaacaggcgatggcgatgctgcagcaatggcttgccgatgaccggttcgtcagtacgcgcctgatcctgctgacgcatcgggcggtctccgcagttgctggagaagacgtgctcgacctggtacacgcgccgctgtggggcttggtccgcagcgcgcaagcggagcacccggaccgattcgccttgatcgatatggacgacgagcgagcatcgcagacggcactcgccgaagcgctgactgcgggagaagcgcagctcgcggtgcggtcgggagttgtgctggcgccccgcctcggccaggtgaaggtgagtggaggtgaagcgttcaggtgggatgaaggcaccgtgctggtcaccggcggaaccggcgggctcggggccctgctcgcacgccatctggtcagcgcccacggtgtgcggcacctgttgctcgcaagtcgccgtggtctggcggcgcccggagcggatgagctggtggccgagctggagcaggccggcgccgacgtcgcggtcgtcgcgtgcgactcggcagatcgggactcgcttgcgcggctggtggcgtcggtgcctgcggaaaacccgttgcgggtggtggtgcacgccgccggtgtgctggatgacggtgtgctgatgtcgatgtcgccggagcgcttggacgcggtgttgcggcccaaagtggatgccgcgtggtacctgcacgagctgactcgggaactcggtctgtcggcgttcgtgttgttctcctcggtcgcgggcctgttcggcggtgcggggcagagcaattacgctgccggcaacgctttcctggatgccttggcgcattgccggcaggcccaggggctgcccgcgctgtcgctggcctccgggctgtgggcgagtatcgatggaatggcgggcgacctcgctgcggcagatgtggagcggctgtcgcgggcaggcattggcccgctttcggcaccgggagggctggccttgttcgacgctgccgttggctcggacgaaccgttgctggcaccggtgcgactggatgtcgaagcactgcgtgtgcaggcccgatccgtgcagacccggattccggaaatgctgcatggcatggcaatggggccaagccg

SEQ ID NO: 3 - DNA, 25360 bp, Saccharopolyspora spinosa
ccgcactccgttcacttccagggttgagccgttgcacgaacggctggccggattgtcggagggcgaacgtcggcagcaagtgctccagcgcgtccgcgccgatatcgcggtggtactggggcacggcaggtcgagcgatgtggacatcgagaagcctttggccgagctgggtttcgactcgctgacggccatcgaactccgcaaccgtctcgctaccgccaccggactgcggcttcccgcgacgctggccttcgaccacggcactgcggcggcactcgcccagcacgtgtgcgcgcagctaggcaccgcgaccgcgccggcaccgaggcgaaccgacgacaacgacgccacggagcccgtgaggtcgctcttccaacaggcgtatgcggctggccggatacttgacgggatggatttggtgaaggtcgctgcccagttgcgaccggtgttcggttcgcctggcgagctggaatccctgccgaaacccgtccagctttcccgtggtcccgaagagcttgccttggtgtgcatgccggcgctgatcgggatgccgcccgcacagcagtacgcgcggatcgccgccgggttccgcgatgtgcgggacgtttcggtgatcccgatgcctggattcattgcgggagaaccgctgccgtccgccatcgaggtggcggttcggacgcaggcggaggcggtgctgcaggaattcgccgggggctcgttcgtactggtcgggcattcctccgggggctggctggcgcacgaggtagccggtgagctggagcgtcgcggggtcgtcccggccggggtcgtactgctggacacctacatccccggtgagatcacgccgaggttctccgtggcgatggcccaccggacgtatgagaagctcgcgactttcacggacatgcaggatgtcggtatcaccgcgatgggcgggtacttccggatgttcaccgagtggactccgacgccgatcggtgctccgacgctgttcgtgcggaccgaagattgcgtcgcagaccctgaagggcggccgtggacagatgactcctggcggccagggtggactctcgcggatgccacggtccaggtgccgggcgaccacttctcgatgatggacgagcacgccgggtccaccgcacaggcagtcgcgagttggcttgacaaactcaaccagcgcaccgctcggcaacgctgacgggcgtccttttaggaccttctgggcggcaccggccaccccggcggtgccgccttccgtggtccaggctcgccgatcttgacggcgcacgatgcgcggcacgcgcgctgatcgtgattccgctgccgctcgtggccatcggcctggcgaatcatgtcctttcgggcaacgtcaaacgaattcgtccgagcccgcattccgaggtgaggggcacccttgggtggctgagccgctcaagggtgcccctcacctcgaaattcgtccgatttgggcggtggacgcaaccccggtgggcgtggtgcgtctttcttgttgacagagcggtgagaagccgctgacacacctgagaggaaaaggggagcatgatgctcaagcgccaccgtttgacgaccgccatcaccggccttctggggggagtactgctggtcagcggctgcggaaccgccgccgcacttcagtcctcgccggcgcccgggcatgacgcgcgcaatgttggtatggcctcgggcgggggcggcggggacatcggcacgtcgaactgctcggaggccgatttcctcgccaccgcgacaccggtgaaaggcgaccccggcagtttcatcgtggcgtacgggaaccggtcggacaagacctgcacgatcaacggcggcgtgccgaacctcaagggcgtggacatgagcaactcgccgatcgaggacctgccggtcgaggacgtgcggcttcccgacgcgcccaaggaattcaccctccagcccggtcagagcgcgtacgccggcattggcatggtcctggccgacagcggcgacccgaacgcccatgtcctcaccgggttccagtcctcgctgccggacatgtccgaggcccagccggtcaacgttctcggcgacggcaacgtgaagttcgccgcgaagtacctgcgagtcagctcgctggtgtctaccgcagacgagctgcgctaaaacccatgtgagtcccgcagattcgacctcgccgtgcggcgcctccggcgaagcgtccgtacgtttgtcgttgtgaccagcgttgttcacgtccgggcgcagcgctggtacatactcaggcgtctcgggcgcctccaacggggcctggcatccggggccgtcgagtgcggcggcgctgacgcgttctctgtcgggcgttgtcacgccgccggcctcgaaccggtcccgccccgtcggagccggtggtccagcgcggtgtggcggcggccggagccgacggtgcgcaccgcctgcccgagggcctttttcgaaccgacgaggaccacgaccttcttggcccgggtgaccgccgtgtagagcaggttgcgctgcagcatcatccaggcgcttgtggtcaaggggatcaccacgcacgggtattcgcttccctgcgaacgatggatggtcaccgcgtaggcgtggaccagttcgtcgagttctgtgaagtcgtagtcgatgtcctcgtcctcgtcggttcgcacggtcatggtctgtgcttcgttgtcgagggcggacacgacgccctgcgtgccgttgaacacgccgttggcgcccttgtcgtagttgttgcggatctgcgtgaccttgtcgccgacgcggaagatccgtccgccgaaccgccgctctggcaggccctccctggccggggtgatcgcttcctgcaacagctggttcagcgcgcctgcacctgcggggcctcgatgcatcggggcgaggacctgcacgtcggtgcgcgggttgaaccggaacttccgcggaatccggcgggcgacgacgtcgacggtgagctcggcggtcggttcgctttcctctacgtggaacaggaagaagtcggtcagcccgtgtgtcagcggatagtccccggcgttgattcggtgcgcgttggtcaccaccccggactcggcggcctgccggaacacctcgttgagccgcacgtgtggaatcggggtgccaggggcgagcagatcgcgcagtacctcaccggctccgaccgacgggagctggtcgacgtcgccgaccagcagcaggtgcgcgccgggcgcgatcgccttggccagtttgttggctaacagcaggtcgagcatggacgcctcgtcgaccacgacgaggtcggcgtccagcgggttgtcccggtcgtaggcggcgtccccgcccggctggagttggagcaggcggtgcacggtcgccgcgtcgtgtccggtgagctcggtcagccgcttcgccgctcgtcccgtcggcgcggcgaggatcaccttggcctttttcgcctgagctaatgcgatgatcgaccgcacggtgaagctcttgccgcagcctggacctccggtgagcacggcgaccttctcggtcagggccagcttgacggcgcgctcctgcgcctcggcgagttcggcaccggtagcgcggcgcaaccagtcgagggccttgtgccaatcgacgtcggcgaagacgggcatccggtccgcgctggtgttcagcagccgggacagctggttggccagggcgacttcggcgcggtggaagggcacgaggtagatcgcgaccgtcggcacctcgtcgtcatcggtggggatctcctcgcggaccacaccttcctcggtgacgagttcggcgaggcattcgatcaccagcccggtgtcgacggcgaggatcttcaccgcctcggcgatcagctcgttctccggcaggtagcagttgccgtcgccggtggactccgacagcgtgaactgaaggcccgcctttacccgctgcggggagtcgtgcgggattcccaccgctttggcgatggtgtcggcggtcttgaaaccgattccccacacgtcgcctgccagccggtatggctcttccttgacggtccggatcgcgtcgtcgtggtactgcttgtagatcttcaccgccagcgaggtcgagacgccgacgccttgcaggaagatcatcacctccttgatcgccttctgctcctcccacgcgtcggcgatcagcttcgtccgcttcgggccgagcttggggacctcgatcagccgcgcgggttcctgctcgatgacgtcgagcgcggcgacgccgaagtggtcgacgatcttctcggcgagtttggggccgatgcccttgatcaggccagaccccaggtagcggcggataccttgcacggtcgcaggcagcacggtcgtgtagtcgtcgacgtggaactgccgcccgtactgggggtgcgacccccaccggccgcgcatgcgcaacgcctcgccgggctgcgcgcccagcagcgcgccgacgaccgtcaccaggtcaccgccccggccggtgtcgatccgcgcgacggtgtagccgctctcctcgttggcgaacgtgatccgctccagcgtgccctccagcaccgcagtccacgtggccgactcccgtcctttttccaccgacaacacgtatcacgaacggctgtcaagcaaaccggcggtcaccacatgcagcggcatctcccgaacgcctcgggctccggcgtcagcgggtgggcgttcgcgatgccttggtgcggccggtgggagttgtagattttttcgtcctcgcgcagggcctggagtaggtgccgctggctccagatcaggggaaagcgccgggataaaccggcttgacggaggagatggaagagctctacgtcgaatggccagcgacccacgacgaccccgagtcatgcgtcgacgacctgcgaggccgtggcgaagcgttgacagggggcacgtgggggcgtgcgatcaggtcgcggcgccggctcagcgccgtgtccggacgcaccagcagccgcgacggactggttccgctcctcgagcgcggtgtcctcgatcgtctttttcgagctcgatgccggccgcgttcgcgaggtggccagtccagtcggtcggcagtcgtggtcgcagtctgccttttgaacatctggtcaattcagctttgaatgatcgttcggcgagtattgtcctgcccgccaattgtttgctcgccgtgcgccctgggacaggagcgcggcgttcggggacggcgtgctggcgaaggtgtcgattggctcggacggccggaccaggatcgccgacgtcgtgatcgccacgagcgtcggcgatgcccggtactatctggagcaccagcgagtggacaacgacttccacgggcgcggtgcgctcctgatcatgaatcaagaactgagaccgtcagggtgaacgtgccgtcgtggggcactgtgaggatgtgcatcacacggccggggtaggtgatcgaggaggccctgatcgcgggctgccgcggctgtgcccagtcgaatcgcagcaccacctggccgcgggtgagcgtcagcccctgcgcgtcgagtgcgactttgtcggagtccctcaccaccaacgggatctgctcggttgccggtgcgttcgcctgcaccgacctggtgatccggtcgggccgcacggtcacatcggtgacgaccgagccattcgcggtgcggtagcggaaccggtatggctcgccgcccaggaactccgcctgctgcggtccgttcgcgtccggcacctggcccgggaagaccgtcgcccagcaggcgtggtcgttgttgttcatcgactggacgaccgtgcccgcgaccgggtgccacaggaacgtcagaccggtgcggcccagcgaggtcgcgcgcctcgtgccgaagtagccgccgaggtagaactgcggcctgcgtaggaacaggaagtcttgcccctggtcgctgcggatctcggtgaagtgcgcctgttggtatggaagtttcgcgatcgcggccgtgcgctgggcgcgggtcggatagcgctcgccgtagatcgcgtgggtgaggatgcgcggtgaggtgtcctgtttgacgagtgcgggcaccggtgccgggtcctcggcccaggccgctcgtgcggcggcgaggtcttcgcggctggacaggaacgcgcccaagttcggcaccactggcacgaactggttgttcagcgcggtacgttccgggtccggtcgcacgtcggcgtagaaccgcgccgaggtgcgggagttgggggcgacgttggcgaaccagccggagccgtcgggttcgcgcagcaggttgtagctgagccagtcggtgtacttccgcgccatcgtgacgaggttggcgttgttggactggcgccacgcgtcggccatctccggcagcatcacctcgaagttgtagttggtgtccgcgccggtcaactcgtagaagtagcccgaaggactctgcccgttcgcggcaaggcgcgcgaacgcctcggtcaactgctgccgcagcgcggggtcggggtcctggttcagcgcgagcgaggagccggcgagcccggcggtaacctggttcgcgtagtggattgtgggctgccaggcgctaccgttgcccgggttgaggagccacgtcatcgctttgcgcagcgccgaggtgatctgcgactggcgttgcggcaggatgttcgccgcgcgcagcagggcgttggtcttgctcaggtaccccaacccgaagccggtggcggcgagcccgtgctcggtcggcgaatactccggccacgagccgtcatcgtgctgcaaccctaggtagtgtccgagcccggcgtcgagcgcggcgagcagagtcgcgtcgccccggtacgggttccacgtgcgggattgcgtggcgaaccaggcgagcgtgtagacgtgctcctggacgcgggcgttgtaggacaccgccgggctgcgccaccagcctccggcgaagaagccgctcgagtccatgtcggcgaccatcggcgagaccgcggtgaggtacgacgcgaatcgctgctcctcgggtgcgaacaggcgccggttcggtgtggtgggcggcggggcgggcagtgcgagtgcgcgggtcggcagtgcggcgagcagtccgagagcggcggcgccggtcatcaggctgcgacggctgaacgtagtcacgggcctacctccttgtggccgatcaaccctcacccgctgcgtagccgcacgtcaagatgataattcgaattattatgggcttgacgacgcgtaggccgacgacgcagaattcctgccaattcgtattggcaagcgggggtgctcgtggcccgacggctcacccagcaggacatcgcccggatggcaggagtcagccaggccacggtgtcgctggtgctcaacaaccggaaggacggcaacgtccggatcgcggcggagacccgtgcgcaggtactggaggtgattcggaagaccggctacgtcgcgaacccgatcgcccgcaggatgcgcgatcggcacaaccgcatcctcggcgtgttcacctacgaggcggtgttcccgagcacccacgcgaacttctaccagtcgttcctcgaaggcatcgaggaacaggccgaggaggtcggctgtgacctgttgttgttcaccagcgccaaggccaccggggagcggcggcggattttcggcgacgacagccgggtgcggctcgccgacggcagtctgctgctcggtcgcacggtcgaccgcgacgacctgacccagctgctcgccgaaagcatcccgtacgtctccatcggacgacgcgacgacgcgggcggtccggtgccgcacgtcggggccgactaccgcaccgcggtgcgagacctggtggaccgcgcggtcgcgctcggccaccgcgggttcgcgtacgtggggtctggtgggggcgcggagtcgtccgcggatcggctgcgaggcttccgcgaagccgttgccgcacatggcgtccaagggatgcatgtggagaccccacagctcgatcagctgcgcgaagcgggcgtcaccgctgtgctcaccgaagaggtgtcggacggggccgcgctcgtgctcgccgggcgcgaacgcgggctctccgtgccgggcgacctcgccgtgctctcgctcggtgccgctacccggtcggcaccggacgacgacgtggcgctcaccggtttccgcatccccaggcgcgagatggggcgccgggcggtgcaggcgctgaccgaggtgctcgaaaacggcaccacaccgcaagaactgctcccgtgcgagttcgtcgagggctcgacgctgggcgcaccacgcctttgaccaggaggaactgttgctcgaccacaccacggacgttgtcgtcgttggcggcggactcggcggtgtcgccgccgcactcgcgttgctgcgcgcgggccgccgggtcgtgctcaccgaggagtacgactggctcggcggccagctgaccagccaggccgtgccgcccgacgagcacagctgggtggagcgcttcggcgtcaccgcgagctaccgggcgttacgcgacggcatccgcgactactaccgccgccactacccgctgaccccgcgcgcacgggcgtggcgggagctcaaccccggtgcgggcaacgtgagcaggctctgccacgagccccgcgtcgccgtcgcggtgatcgacgagatgctggcgccgttccgcggcagtggcaggctgaccgtgctgcagccgtaccggccggtggccgcgcacaacgacggcgaccggatcgtgtcggtgaccgttgcgcaccgcgacaccggtgaacagatcgagctctccgcgccgtacatcctggacgcgacggagacgggtgaactgcttccgttgtccagcacggagtacgtcaccggcttcgagtccactctggacaccggcgagccgagtgcgcccgacgtcgcgcagccggcgaacatgcaggcggtgtcggtgtgcttcgtggtcgaccacgtcgacggcgaccacaccatcgacaaaccggcgcggtacgacttctggcgcgcgtaccagccggacttctggggcgaccggatgctgtcgttccgctcccccaacccgcgcacgctcgcgatctccgaacgtacgttcaccccgaacccggacgacgacccgctcggcgtcgtgtcggaccagcggctcagtgccggtgacagcaatctgtggacgttccggcgcatcgccgcgcgtcgcaacttcgtcgagggtgcctacgacagcgacatctgcctggtgaactggccgatcatcgactacttcgagtcgccggtgatcgacgtgccggacgccgacgcgcacatcgccgcggcgcgggaactctcacgttcggtgctctactggctacagaccgaggcgccgcgcccagacggcggcaccggcttccccggcctccgcctgcgcggcgacgtcaccggcagcgcggacggtctcgcgcaggcgccgtacatccgcgagtccaggcgcatcagggccgagcacacgatcgtcgaacaggacctctcgctcgccgtgcgcggcgacaagggtgcggtgcagcacgccgacgccgtgggtgtcggcatgtaccgtatcgacctgcacccctccaccggtggcgacaactacatcgacgtcgcgagctgcccgttcgagatcccgctcggcgcgctgatcccgcaacgggtggagaacctgctacccgcgggcaagaacatcggcaccacccacatcaccaacggttcccaccggctgcacccagtcgagtggaacgtcggcgaggtcgcgggcgcgctcgctgccttctgcctggcgcaccgagtcacccctcgcgcggtgcgcaatacccctggcctgctcgcggacttccagcagtgtctggaacgcgacggggtcgagctccgctggccggacgtgtccggctactgacgcagggagacgaaaatgacaaagctgtcacgacgactcacggcactcatcgtcgcagggctgttcgccctcaccggctgcggtggtggatcaaccgcacagtccggaccgaagtcgctgcgcatgaccgtgtggactgccaacgcggcgcatctcaagctgctcaacgacatcgccgccgagtacaaggcctcgcacccggacatcgccgagatcaagttcgactcggtgcccgccgacggctacaccaccacgctcaccacccagatcgccggcggtaacgcgccggacctggcctggatcctggaggagtcggcaccggacttcgtggcgtccggtgcgctcgccccggtgcgcggcaagatcgagaaggccgacgagctcgtgccgtccgcgacgaagctgtgggagaaggacggcgaactgtacgcctacccgttctccacctcgccgttcggcttgttcgtcaacaccgacctggtgaagggcgcctcggcggactggacctgggaccaggcgatcgcggctgcctctgcgtcggcggccgcctccggcaagggcggcctggtactgccggacttcaagtaccagaactgggcagtgctgtcctctatctggcgcggctggggagctgatgcgtggagcgcggacggtcgctcgtgcgggttctccagcagcgagatgaacgacgcgatgtccttcttgcacaaggccatcttcaccgacaaggcgattccgggccccggcacgacggtggacttcttcgccggcgacgcggcgatggcgatcggccagatctcccggtccagtgcgttgaaggacgcgaagttcggctggacgctgctgccgctgccggccggtccgaagggtgactacgcggtgatcgggcaggccgggatcggtgtgctgaagcagtcgcacaacgtcgacgccgcgacggacttcctcgccttcctcaccaaccagaccaactccgccaagctcgcgcagttcttccccccggcgcggtcgtcgctgctcaacgcggagacgctcgccaagagcaacccgttgatcaaggccgagcaactgcagtccgtcgtcgtcgacggcatcaacaagggcgtcgtgaagccgagccacaagggtcaggaggagctgaaccagacgatccgcgccgcgctcgacccgttgtggaagccggacgcgaacgtgcagaacgtgctgaacgacgtgtgcaccaagatcaaaccgctgctggagaacaagtgacggcggtcgcacactccacgcgggccgtagcccgcaaggggacgtcgtactggacgcagcgcaggcgcgacaatctggttggttacctgttcgtcgcgcccgcgctgctcggcagcatcgcgttcgtgctggtgccgctggccttggtcggctggtacagcctcaacgagtggaacgtgctcgccggcacgttcgagttcgtcggcgcgcagaactaccaacagctgctcgccgacgagaagctgcgcgactcgctggtggcgaccacttggttcgccgccggcctggtcgtgctcaacctgtcactagcgctgctgctggccgtgctgctcaaccagaagctgagcggcaccacggtcttccgcacgttgttcttctctcccgtcctcgtgtcgctggtggcgtggacgctggtgtggcagctgatactgcagccggagggcagcgtcaacggactgctcgggttcttcggtgccgacgggccgaactggctgcgcggtgagtcgaccgcgatggtctcggtgatcgtcgtgcaggtgctcaagaacgtcggcctgaacatggtgctgttcctcgcggcgctgcaaggcgtgccgcagccgttgtacgaggcggcgaagatcgacggggcgggtgcctggacccggttccgccgcatcaccttgccgttgatcagcccgacgatcctgctcacgtcgatcatcaccatcgtcggctcgctgcaggtgttcgcgcagatcgcggtgctcacgcagggcggtccgggcacgtccacgaccgtactgatctactacctgtaccagcaggcgttccagttccaccacttcggctacggcgcgacgatctcggtactgctgttcgtcatcgtcgccgcactcaccctgctgcagtggcagatgcgccggaagtgggtgctgcatgaggcttagggtcaagatcacgctatacgggctgctgtgcctgctgtgcgtgcctttcgtgttcccaacctggtggatgatcacctcgtcgatgaagcccatcagcgagatcttctccacctcgccgctgccgtcggagtggacgttctccacctaccggcaggtgttcgagatgcagccgttcgcgcagcagtactggaacagcctctacatcgcggtgatcgtcacgacaggcacaatggcggtggcggcgatggccggatacgcgttcgcgcgtatccggttcccgggccagaacgtgctgttcgtggtcgtcctgatcggcctgctcatcccgagcgaggtcaccatcgtgccgctgttcaagatgttccagtcgctcggcctgaccaacacgcactggccgctaatcatcgtgccgatcttcggggcgccctgtgtgctggcgatcttcatcatgcgccagttcttcatcgccctgccgtcggagctggaggaggccgcgcggatggacggcctcggacgagcgggcatcttctaccgggtggccctgccgctgtcccggcccgcgctgggcgccgtcgcgatcttcacgttcctgcactcgtggaacctctacctggagccgatcgtctatctgtccacaccggacatgtacacgttgccgcaagcgctcacgcagttcgtcgacaactacggcggcccgatgtggaacgtgcagctcgccgccgcgaccatgaccgcagtgccgattctcgtcgtgttcgtgctggcgcagcggcagttcatcgagggactcgcgcacaccggggttaaggggtgagtcccgcgatcgacccggagatcgccgcgctggtagacctcgccagaccaccggtgacgccagcgggaatcgacgcggtccgggcgggaggacgcgtcgtcaccgatgccgagctgacgcgcggtggcaccgtgacgttcgccgatgccgatgccgatggcgtgcccgtgcttgtgctgcgcccagcgggtgtgccacgtcttccggtgctgcacctgcacggcggcgggatggtcgcgggcacccggcgcaccgacctgcacgtgctggccgagtgggtgtcggagctgggtgtcgtgctggtgtcgccggagtaccggctcgcacccgagcacccgcacccggcgccgtcgcaggactgcttccgggtgctggagtggatgtcccgcaacggcttcggcccgcctgtcgttgcgggtacatcggcgggcggcgggctggcggctgcggtgacgctgatggcccgcgacctcggcggtccgccgatcttgccgtcggcgcgcaactgctcgaacgcgtccagcgtctccgccaacggcgtgctaccgcgccagtgcagcaggtagacgtccaggtgatcggtgcccaaccgccgcagactgcgttcgcacgcctcgacggcgccacgccgacccgcgttgtgcggatacaccttgctgaccaggaaaacctcgtcgcggcgcccggcgatcgcggcaccgacgacctcctcggcgcccccgctgccgtacatctcggcggtgtcgatcagccccaggccgaggtccaggccgcgccgcagcgcggcgacctccgccgcgcgctgcccacgccgctcccccatgccccaggtgccctgccccagcaccggcaattcctgcccgccacgcagttgaaggcctcgcatgcacactccgtttcagtcagcgctgctgcggcagcacggccaccagctcgaagccaccgtcctcggacggcccggcggccaaccgcccaccggccatctgcacccgctccgacaggccggccagcccggacccgccgctgccgacctcgatggccggtccccgccggtcgggggcgccgtttgtgacggcgacgtgcagcgagccctcgcggaacaccagccgcaccttgatgtcagcaccgggtgcgtgcttggaagcgttcgtcaacgcctcctggacgacccggtaagccgcgcgctcaaccgcaggcgacaccccgtgcgggtcgcggatctccgaggaaagctccacatccacaccggcggcgcgcgcccgcacgaccagctccgggatcgtgctcaacccggcccgctgcctgggggcgccgagcccgagcgtcgcgcgcatctcgtccagcgcctgcttcgccaacccgcgcagccgcccggcggtctccttcgcaccgggatcctcggtggtggccgccaacgccgccgactcgaccgcgattaaggtcacgtgatgtcccaccgcgtcgtggatctcccgcgcgatccgggcccgctcctccgcgcgcgccgtctcggccttcgcctgcaactccgcctcggtggccgcctccagcttccgcagactgtccgccagctgctcccgcaacgccaccagcgcccccaatgccgtcggcgcgcctgccgccagcagcacgaacgccacggtcaggatgatcgacccgacccccagcgactgcatgatcatcaccggtgccacggcgaccgccgcggtcagcaacacccagccgaccaacatctggatccgcggctgcgcgcgccccaacgcgtacaacgccacgaccgtcggcgcccaacccaaaccaccggccaacgctggcatgcacagcagcaccgcgatccgcggccaccgccgcaacggcagcagcgccgaagccaccaaaccggacaccgtcgcatagccgaacgggtcgggcgcggccagcacagctgccgccggaatcccgacgaccagcgcctcaacgccgagccgagaccagcgcaccgaactcaccggaagccgcccgccacgcgctgcgcgatcaacgcggcctgcacccggttctgcgcgccgagcttgctcaacaccgtcgacacgtagctcttgaccgtcgcctcggtcagcccgagccggaccccgatatcggcgttggaccgaccatccgccaacaactggagcacctgccgctcccgcccggacaacccctgcaccagctgcgtctcgtgcgcgttgtcggacagactgcggaacctgggcaacaaccgcgcagtgatccgcggatccagcaccgccccaccggccgccagatcgtgcaccgcccgaaccagcaccgcgggctccgcgtccttgagcaggaacccgtgcgccccgaaccgcaaggcatcggccacgtaatcgtccaggtcgaacgtcgtcagcaccgccggcaccggcggattcgccaacgtcgccaagtcccgcaacgccgtcagcccgtccttgccgggcatctgcacgtcgatgagggcgacgtcgacgcggtacgcgcgcaccgcggccagcaactcatccccgttgcccgcctcggcgaccacccggatcgagccgtcgccctccaacaacacccgcaggccacgccgcagcatcgcctcgtcatcggcaagcacaacgcggatcggccccccgccgtcgtcagcccgcacctctcggtcacctccctgttccgagggtcgccagcagactagcggggccgcgaaagcgcagcgcacacgccacccgagcgcactgtgtcagcggcgcccgcccttggccttccgctcccgcacccgcaccgagatccgcaccgggctacccacgaacccgaacgtctcccggaacctgcgctccaggaaccgccggtacccggcctccaagaacccggtggtgaacagcacgatcgtcggcggccgcgactgcgcctgggtggcgaacaggatcttcggctgcttgccgccccgcaccggcggcgggttggccgcgaccagctcggaaagccaaccgttcaaccggccggtggagatccgggtgtcccacgaatccagcgccgtgcgcagcgtcggggccagtttcgccaccgcgcgaccggtcttcgccgacacgttgacccgctcggcccaccgcacccgcaccagctcgcggtcgatctccttctccaactggtggcggcggtcctcgtcgaccaggtcccacttgttgtaggcgatcaccaatgcccgaccggcctcgacgaccatagtgatcacccgcaggtcctgctcgctcaacggctcggagccgtcgatgagcacgatcaccacctcggccgcctcgatcgcggccttggtgcgcagcgacgcgtagtactcggtgccgcttgcggtcttcacgcgcttgcgcagcccggcggtgtcgacgaaccgccacacctggccgtccagctccaccagcgagtccaccgggtccaccgtggtgcccgcgacgtcgtgcaccaccgaccgctcttccccggtcagcttgttcagcaggctcgacttgcccacgttcggcttgccgaccaatgccacccgccgcggcccaccggtcgcgccgaagatctcgcgcggcgtctccgggaacacctccaggacggcgtccagcaggtcaccggaaccgcgcccgtgcaacgcgctgaccggcatcggctcgcccaaccccagcgaccacagcgaatgcacgtcggagacgcctcgctggtcgtcgaccttgttggcggccagcagcaccggacgcttggaccgccgcagcaccctggccacggcttcctcggtctcggtggcaccgacccgggcgtccaccacgagcagcaccgcatcggcggtgtgcatggccagttccgcctgcgcggccaccgacgcctgcagtcccttcgcgtccggctcccagccaccggtgtcgaccaccgtgaagcggcgcccgttccacaacgcgtcgtaggccacccgatcccgggtgacaccaggggtgtcctgcacgacggcttcccgacggcccagcagccggttcaccagcgtcgacttgcccacgttgggacggccgaccacggccagcaccggctgcggcttcgtcggctcctcgccctcgaccgcttcgacctcgtcgaactcagcccactcagcctcgtcggaccacgtgccgtccaggccttccaccgactcgtcggtcacgctcgtttccctctcgaatagtcttggctctggtccgcgaccagccgatccagctcggcgatcagctcgaccagttcggtgcgcaccgcctcggtcgccacgaccagcccggcgcggcctttgcccgccggcagcacgatcggctccccgaacaacacgtcgatcctcggtagcagcctacggcccgggccatccgggcggcgcgtgccccggcaggccaccggcaggatcagcgcctccgacgtccgcgccaaccacgccgcaccgtgctgcgcattggtcacatcgccatcaccccgggtgccctccgggaacaccccgacgagaccaccggcccgcagcacccgcaccgccgccagcagcggggcgcggtccggcgcaccgcggcgcaccccgatctgcccgatgcggcgcaggaaccagcccagcgcaccgcggaacatctcctgcttgatcaggaacaccgcgtggcgcgggatcattccgaacagcagcggcccgtccatcatcgaactgtggttggccaccagtaccaccgggcccgtgcgcgggatccgctccgcgccgtggatccgcacccggtacggcagctgcacgatccggcgcgaaatccactggccgcaccggtgcattccaccggacgcgccctcgggcagggtctcgtcgctcatggcgtcgtccgctccgccgcgaccagcaggccacggcactccacgtgcttgcgcaactgcgtgagcacctccaccacacccaggtccgtggtgtcgagctccaccgcgtcgtcggccttgcgcagcggcgccaccttccgccccgagtccagcgcatcgcggcgctgcacgtccgcgtgggtccggtccaggtcaccggcccgtccctcggagacgtcctgcgccgtgcggcgctgcgcgcgggcgtgcgcggacgccgtcaggtagaccttcaaacccgcatccggggccaccacggtgccgatgtcgcgtccctcgacgaccatgccgcctggcgacaccagcgcctcaccgatcagcttccgctggtgggcgaccaactgctcccgcacctcggcgaccgccgacaccgccgacaccgcgccggtcacctccggcccgcggatctcccgccccacgtccgagccgtccaggaagatctcagggccctccggatcggtgcccaccgtcagccgcgctgcgcgcaccacgcctgccactgcggccggatccgacgggtcgacctcggcgcgcagcaccgccagcgtcacggcgcggtacatcgctccggtgtcgaggtaggtagcccccaatgcgaacgccaacttgcgggacaccgtcgacttgccggtgcccgaagggccgtcgagcgccaccacaccaaggagcctggcgtgtgccacgtgcatgtccttcccgagccggaaccgatcggcccgacacccggccggaccaaccgtccattctgcctggtccgctcctgccgatcccaatcgcatccagatccaatccggactgcgggacaaatacgaaagttctacgaataaggtcttgggtgtggatgtaactgtgacccccttgccagggctcggcacgcagcaggacttcaccacccgatccggccaccgcatcggcgtgatcacctaccgggacggccgcttcgagctgatcgtctccgaccacgaagacccagacaaggtggccgcctcggtcgccttgaccacctccgagaccagcacgctggccaacctgctgggcgccccgcagctggtcgcccagctcaacgagcagcacagcgaggtcgccgggatcaccacctggcagctgtccgtcgccccgggctccccctacgccggccgaaccctcggcgacacggagatgcgcacccgcacctccgtgtcgatcgtcgcggtcgtccgggacggcaccgtgcacccctcaccgcggccggacttccagttctccgccggcgacctggtggtggtcgtgggcaccgcgaaggggctacgcgcagccagcgaaatcctggaaaagggctgatccggcccgtcccgaacactttcccggccacctgaccgggacacgcgtcaccaacggcggtccagcgcgtgccgatcccctaacaactccatacgcagggcacacgcgagaggaaacacgttgcaagacacggcgatctccctaatagaactgggtgcggttttcttcggtctgggcatcctcgggagactcgcatggaaaatcggggtgtcaccgatcccgctctacctgatcggcgggctggccttcggcaccggtggcctggtccccctgcacggcatcgaaccgttcacccacctcgcctccgagatcggcgtggtcctgctgttgttgctgttaggcctggaatactccgcgggtgaactcgtcaccggcttacgccgctcctggctggccggtgtcatagacatcgtgctgaacgcggtacccggtgcgctggtggccctgctgctgggttggggtccgctcggcgcgttcacaatggccggcgtcacctacatctcttcctccggcatcatcgcgaaggtgctcggagacctgggtcggctcggcaaccgggaaacgccggtgatcctgtcgatcctggtcttcgaagacctggcgatggccgtctacctgccgatcctgaccgccgtgctggccggggtcagcttcctcggcggactgaccgcggtcggggtgtcgctggtcgtgatcaccctggtgctggtggtcgcgctgcgcttcggcaagtacgtgtccgcgctggtcgacagccccgacccggaggtcttcctgctgcgcctgctgggggcggcgctgctcgtcgcggggatcgcctcggagctgcaggtctcggcggcggtcggctcgttcctgctgggcatcgcgatctccgggtcgaccgcggcgaacgcgacccgcatgctggagccgctgcgcgacctgttcgccgcgctgttcttcgtcgtgttcggcctcaacaccgatccgagccagatcccgccggtgctgccggtggcgctgctgctggcggtggcgacctgcgcgacgaaagtgctcaccggctggttcgccgcccggatgcagggtgtcggccggatgggtcggctgcgggccggtgccgcgctggtggcgcgcggcgaattctccatcgtgatcgccgggctggccgtcgcctccggcgcggtgccgggcgagctcgccgccctcgccaccgcctacgtgctgctgatggcgatcgtcggcccggtcgcggcccgcgtcgtcgagccggtggcccggatgttcctccccagccaggcgaagaaggcctgaccggaaaagcctccggctgtcccgagcggacgggccggaggctttctcaacgctgcggataacgcgggcgggtctggcaaacgcaacaccggtgcgcgaacagcctcagaggcccactgcgcggtagagcgagccgatctcctggcggttcaacggccggatcgcgcccgggcgctcgttggtcagccgcacatcgccgatccgcgtccgcaccaggcgctgcaccgggtagccgacgtgcttgagcagccgccgcacgatgcggttgcggccctcgtgcaacacgatctccaccagcgaccggttctggttcatgtcgaccagcttgaaccggtccaccttcaccagaccgtcctccagctccacgccctcgcgcagctgctgcccgaggtccttcgggatcgaccccagcacctccgccaggtacgtcttgcgcaccttgtacgacgggtgcatcagccggttcgccagctcgccgtcgttggtgatcagcagcaggccctcggtgtcctggtccagccgccccacgtggaacagcttgccctcccgttcccgcaggtaatcaccgatgcacggacgccccttgtcgtccgacatggtgcacaggatgccgcgcggcttgttcagcagcaggtgcgtcagatcgtcgttgaccatcacccggttgccgtccacgtggaccaccgcggtcgtcgggtcgacccggcgccccagctcggtgacgacctcgccgtcgacctcgatccgcccctcgacgatcatctcctcggccgcgcgccgcgaggccaccccggcctgggacaacactttctgcagccgcacgccttccgaatcggcagtgctgctgtacggggaacggtgctcagacgtcatcaatcgaatccacttcgggcaacaagggggcgagcggcggcaactccttcaacgacgacagccccagccgctccaggaacagctcggtcgtgcagtacaggatgccgcccgtctccgggtcggttccggcctcttcgataaggccgcgccccaccagggtacggatgacgccgtcgacgttcacaccccgtactgccgcgacccgcgaacgcgtcaccggctgccggtacgcgatcaccgcgagggtctccagcgcggcacgcgtcagcttcgaacgctgcccgtccaacaggtaccgctccacgtacggggcgtacttctcccgcgtgtagaaccgccagccgtcgccgacccgccgcaggtcaacgccccgttccgcctcggcgtagccgtccgagagccgccgcagcgcggaccggatccgggccaccggctgctccagggtgtcggccagcagctcctcgccggccggcacgtcgaccacgagcagcaacgcctccagcgccgcatccagcgccgaatcggaggtcaggtccggcgcactcggcgcctccaccgcctcggaatccccagcggccgccgacggctccaacggttcctgcggctcagcgggcggcggggtcggcgactcctccgcgacctcgcccgcggcctccggctccagctccgtcacccgtactcctcttcttcatggctggcgcgctgcgcctcggcttcggcctccgcctgcgccacgctgccgcccacccagctcacgatcagctcacccagcggggtctcctgctcgaacagcaggaccttctcccggtagagctcgagcagcgccaggaaccgcgccaccacctcgacggtgtgcccgcagtccgacaccagctccgagaacgtcgcgctgcccttctccgccaaccgcacccgcagcagcgccgcgtgctcgcgcaccgaaacgccgtgctggtggatgtggtccagcgaaacggtcggcggtggcttcggccggaacaccgcggccgcgatctcggcgaaccgctgcggcggaaccccgatcaccacttccggcagcaggttcgcgaaccgctcctcgaccgacaccgaacgcggatagcgccgcagcgccccggcctccaactcgccgaacagcgcggccacctgcttgtacgcgcggtactgcagcagccgcgcgaagagcaggtcgcgggcctccagcagcgccaggtccgcctcgtcctcgacctccgcggccggcagcagccgggccgccttcaggtctaacagcgtcgcggcgaccaccaggaactcggtggtttcgttcaggtcccaccgctcgccgagcgccttggtgtaggcgatgaactcgtcggtgaccttgtgcagcgctacttcggtaacgtccagctggtgctgcgagatcagctgcagcagcaggtcgaaggggccctcgaagttgtccagccgcaccgtgaaccggccgcctgcggcgggatcctcgctcgactgcgccgccggtaccgcggggtctgtcactctccgggctcctgcaggcgccgcaccagcaccgagtccgcgccgttcttgtcgaggtcggcgagcaccacggcaaccgcttcgcgcaccacgcggcctcggtccacggcgatgccgtggtcggcccgcaatgccagccgcgcctgctccaagcccagcaactcctcgtcggacacgtacacggtgatcttcgaatcgtgcttgcgccgtccagagccgccccggcccgccgcgggtgccgcctgctccgggtccggcggattcgcgtgatccgtccgaggaacagtagtacggaacaattcggccgctccgggcagggcgacccgacgcgtcatcgggcgatcacctcgcgcgccagtgcgcggtacgcctgcgccccggccgagcggggcgcccagcgggtgatcggctcgccggccaccgtggtctccggaaaccgcaccgtgcggttgatcaccgcatcgaagacgatgtcgccgaacgcctcgacgacgcgcgccatcacctcgcgcgagtgcagcgtgcgcgggtcgaacatggtcgccaggatgccgctgatctccagcctcgggttcagccgctcccgcaccttctcgatggtgtcgatcagcagcgccaccccgcgcaggctgaagaactcgcactccagcgggattatcacggcgtccgcggcggccaacgcgttcaccgtcagcagccccagcgacggctggcagtccaccagcacgtagtcgtactccgccagcgccggctgcagcacccggtgcagcgtctgctcccggcccacctccgcgaccagctgcacctcggccgcggacaggtcgatgttgctgggcagcaggtccatgccctcgacggtggtctgccgcaccacgtcatggatggcgaccggccgttccatgatcacgttgtagatggtctggtcgagctggtgcggctggaccccgaggccgaccgagagcgcgccctgcggatcgaaatccaccagcagcacccggcgcccgtattccgccagcgctgcgccgaggttgatcgtcgacgtggtcttcccgacgccgcccttctggttgcacatcgcgagcaccgatgcgggaccgtgccggtccagcagcggcggctcggggatgtgccgacgtggccggccagtgggaccgaggccgcgggggttcggcgccaggccgacctcctcctcgcggcccgccgtctcccgggcgatgctcaggtcgaccgcgccccgggaccgcccttcggcggcgggctgcggcagcgacatggcgatctgactccttttggtgccggtggcgatcaaacgcagcctaagtggcattcgttaccagcggcaacgcgcctcgccgtggtgtcggaagttccctgtgatctgcgtgtgatcaacgtctaccgcgtacaccaccccctcgcattcgcagcgtcaccaagtcactccgtagcgtgtgcgcgcggatgcgtcgtcgcgtagacctcccgcagcgtgttcaccgtgatcaaggtgtagacctgggtcgtcgtgaccgaggcgtggcccagcagttcctgcaccacgcggacatccgcgccgccctccacaaggtgcgtggcgaacgaatgccgcagcacgtgcggcgaaaccgagccgttgatcccggcgcgctgcgcggcggtcttcaacgcgttccacgagctctgccgggaaagccgggtaccgcgcgaattcaggaacaccgcggcactaccccgcccgcgcgcggccaggccgggcctggcccgtaccaggtacgcgtccagcgccgccagcgccggtcggccgatgggcaccagccgctggcggccgcccttcccttccagcagcacggtccggttggtgccgtcgatgtcgtcgaggtccaacccgaccgcttcggagatccgcgctcccgtcgaatacagcacttccagcagcgcccggtcccgcaggccccgggcatcctcgcccccggcgtgatcgagcagcttcccgacgtcgccgatggaaagcgccttcggcagccgcttcggcgggctcggcggcgcgacatcgcgcgctacgtcgaccggcagcagcccctcggcgtgcgcgaagcggtgcaggccgcgggcggccaccaaagctcgggccgacgacgacggcgccagcgcgggccgctgcccggtgccttcccggagctccgccaagaacccggacaggtgctccgaacgcacctcgccgagcccagaaatccctgccgcgaccaggaattcggcataccggcgcaggtccctggcgtaggagtcgagagtgctgcgggcggtaccgcgctcgacggcaaggtggtcgaggtacccggtgatcgccccgcgcaggtccggcggcagctcctcgaaacccctcaccgggcggcgaagcgctggggccggtccggccattcggcatccgccgggcgaggctccacccggccctcgcggaccgcgtgggcggcgagcagccccgccaccccggggccgttgacgatctccccggccagcgccatccgcaccgcctcggcgagcgggaagcggcggatc

SEQ ID NO: 4 - DNA, 45624 bp, Saccharopolyspora spinosa
tcagccgaccggcttccgcgccgtcagaatcgcatagcccatgtcgtgggcatatttctcataatcgcagaccgcggcggcccagccggcgacagccggcccgtacctgtccgcgatcccgtgctggtgcgcagcgagctcttcggcgaactgcggcatgaagtaccgggtcctcgacgacacgtcctcccaatcgaggatctcgaaccccgctgcacgcagcgattccagaagttgctcagccaggcagatccgaaggccggtcggccacctgtccccggacaccggcatcccgccgcccgcttctcgtttgacgacctcggtgacgccgaggatgccaccgggtttgagtactcgaaggatttcccggatggcacggtccggttcggacatctccaacagcgactgcatggcccaggcggcgtcgaaagcattgtccgggtacggcagggacatggcatcgacgcacgagaagtccacccggtggcttagtccgcgttcgcgtgcgcaatcagcggcgatggccacttgcacctggctgacggtgatgccggtgatctggatcgcgttgtcgcgcgcgacgcgcagcgctggttgtccggtaccgcaccccacatcgagcagtcgaacgccgccatcgagcacggtccgttcggcgacaaggtcggtgagccggtcggcggcctgctgccaggaagcccgcccgtcgttctcccagtagccgtggtggatggcgcaggggccgcccgcgaccgagttcagcaacggcgtgaccaggtcatacatctgcccaacctgctgcgatgttggtgcgccacctggcaacaccggtatgcctgatctctgcaacgttcaccttctcgtaattttctggaaccgagcaggaaacacacagagagaaaagacggcaaactagccgtcagttaattcgcggttaccgccgcatgcggcggtaccgactataactatccggccaggaggcaaacagccagcgcaaatcttccccatgaatccccgcagaaccaacggtgatcaccgtacaggtccggcccaccccgatcgagcggagctcgcgcatttcactcgttcgcgtgaaaccaggtgcggcgacccaaagatcttcgatggtcgcgtgacattcctgccgtgacacactattgttgccgccggaagtccgttggacgtcaacggcgatcgacatacgcagcgcattttccaaatcctggccaatgggagtaggggctgctgcgctaatcgggggaaagagactggggtccgaagtatgcgcgtactcgtcgttcccttgccctatccgacgcatctcatggcaatggtgccgctgtgctgggcgctgcaagcatccgggcacgaggtcctgatcgccgcaccaccagagctgcaggcgaccgcgcatggtgcaggtctcaccacggccgggatccgcgggaacgacaggaccggcgatacgggtggaaccacgcagctgcgctttcccaatccggcgttcggtcagcgcgacaccgaggcaggccggcaactgtgggagcagaccgcgtccaatgtcgcgcaaagctcgctcgatcagctccccgaataccttcgactggccgaggcctggcgaccgtcagtgctgttggtcgacgtctgcgcgctgatcggccgggtgctcggcggattgctcgacctgccggtcgtgctgcaccgctggggagtcgaccccaccgcaggccccttcagcgatcgagcccacgagttgcttgacccggtgtgccggcaccacggactgaccggcctgcccactcccgagctcatcctcgatccctgtccgccgagcctgcaagcaagcgacgcgccgcaaggcgcaccggtccagtacgtgccgtacaacggaagcggcgcattcccggcatggggcgcggcgcgcacctcagcacggcgggtctgcatctgcatgggccgcatggtgctgaacgccaccgggccggctccgctgctgcgcgcagtagcggctgccaccgagttgcccggcgtcgaggccgtgatcgccgttccccccgagcaccgggcacttctcaccgacctacccgacaacgcccggatcgccgaatcggtcccgctcaacctgttcctgcgtacctgcgagctggtcatctgcgcgggcggctcgggaacggcattcaccgcgacccgactcggcatcccgcaactcgtgcttccccagtacttcgaccagttcgactacgcgcgcaacctcgccgctgccggggcgggcatctgcttgccggatgagcaggcccagtccgaccacgaacagttcaccgactcaatcgcaacggtgctcggcgacaccggcttcgctgctgcggcaatcaaactcagcgacgagatcacggccatgccccatcccgccgcgctggtgcggacgctggagaacactgcggccatccgtgcctgatgaactagtcacccgagaacagctggatccggagaaccgatgccctcccagaacgcgctgtacctggacctgctcaagaaggtactcaccaacacgatttacagtgatcggccgcatccgaacgcctggcaggacaacaccgactacaggcaggccgctcgggccaaaggcacggactggccaactgtcgcgcacacgatgatcggtctggagcggctggacaacctccagcactgcgtggaagccgtgctcgcagacggtgttcccggggatttcgccgagaccggtgtctggcggggcggcgcatgcatcttcatgcgcgcggttctccaggcattcggagataccggacgtaccgtctgggtagtggattccttccagggaatgccggaaagctctgcgcaagaccaccaagcggaccaggctatggcgctgcacgagtacaacgacgtgcttggcgtatcgcttgagaccgtccggcagaacttcgcccgctacgggctgctcgacgaacaggtcaggttcctccccggctggttccgggacaccttgcccaccgcccccatccaggaactcgccgtgctacgactcgacggcgacctctacgaatccacaatggactcattgcggaacctgtacccgaagctctcgccgggcggattcgtcatcatcgacgactattttctgccgtcctgccaggacgcggtgaaggggttccgcgcggaactcgggatcacggaacccatccacgacatcgacggcacgggcgcctactggcgccgcagctggtgaacggctcagccgtcctcgacgccgagcgcttgccggggcacgaaccccggcgcggcaggctcagcgttgagccctttctccacgaataccaggttgtggtagaagtgcagggccgccacgttccgttccgtgtaggagggctcggtcccgcaccgcgattcgcgctcctgataatgcaggccgtcgatcagttctttgagcatgtcgatcgaggtgcgctgggccgcgggttccccatcgcgaccgccgtagccgggccagtacgccgtctggagatcctcgatgacgtacaaaccacctgggcggacgtgcggaaacagggattggaaggatttcttgacgtggtcgttgacatggctgccgtcgtcgatgacaatgtcgaacggcccgatcttccccgccatgtcttccaggaattccgcatcgctctggtcacctcgcagctttcgcactcggtgcccttcgttcccggctttctcgaaaatgtccagcccgtaaacgagacctcgccggaagtaccgctgccacatgcgcagcgaagcaccaccgagttcgggtgcgtgataaccaccgattcctatttccaacactcgcaccggggcatcctggaatcgggagaagtggtgctcgtagtgttcggtgtaccagtgcaggtccgcccatttgtcggatccgtagcggactgccagcgcaccgaggtccgcgcgcctggtggcggctgcggccagcacggcgtgcaccgcggtggacaccctgttccggaacgccagcaggcgctgcgcgccggcgaggccctggtcgggcgagaactgcgtcatgctgtccgaccagcggacttcacggctgttgtgccgcctgccgtcaaccgggccgaagagcccttccagcagatccaccgcgtcgaaccggagaacagcagctgcttcggcgaccgccgcgagccgcaggcctgcgtgatcgagctcaacggttctccggaccagctgagcgccagaagtgatctccaggccgattcgcaccgactcgtccaacgacagcggatcgcagcgtacgacgagttcgtcgacgatggcgtcggccaccgcgtccagtccggccacctgcactgcttcctggagcttcgccgggcccgcacccgccgcgagcagcaaacgctccaccaccgaccagggggcaactgcgatctcactcatggaaagtcatcaccttttcggttccagcgcatacggcaccatgcgcaccgcgatatcgatccacaaagtagagccggcggaggcgaccgggtttcacgtatgagctgaaacacacagataatcacccggacgcgtagatgatctcggctgcgggcgaacaaagtggaccagtcagaaaaggaggggcggtgcccgaattccatgacccggcacccatgaatcgtcgaaccccaggaacagagatcaccgtcgagcccgacgatcctcgttatccggacctcgtcgtcgggcacaacccccgtttcaccggaaaacccgaacgcatccacatcgccagctccgccgaagacgtcgtgcacgccgtcgccgacgccgtgcgcaccggcaggcgggtaggggtccgcagcggcgggcactgcttcgagaatctcgttgcggacccggcgatccgagtgctcgtcgacctctccgagctcaaccgcgtgtactacgacagcacgcgcggggcattcgcgatcgaggcgggcgccgccctcgggcaggtgtaccgaaccctgttcaagaactggggcgtgacgatcccgaccggcgcatgtcccggggtgggcgcaggcgggcacatcctcggcgggggatacggcccgctgtcgcgccgattcggttcggtcgtcgactaccttcaaggcgtcgaggtcgtcgtggtcgaccaggccggtgaagtgcacatcgtcgaggccgaccggaactccacgggcgccggtcacgacttgtggtgggcgcacaccggtggcggtggcggcaacttcgggatcgtcaccaggttttggctccgaacgccggacgtggtcagcaccgacgccgcagagctcctgccacggccgcccgcgacagtgctgctccgatcgttccactggccgtggcacgaactgacagagcagtcattcgccgtgctcctacagaacttcggcaattggtacgagcagcacagcgcgcctgaatccacgcaactcgggttgttcagcacgctcgtctgcgcacaccggcaagctggctacgtcacgctgaacgttcacctggacggcacggatccgaacgcggaacgcaccctggccgaacacctgtcggcgatcaacgcccaggtcggcgtgactccagccgaagggctgcgggaaaccctgccgtggttgcgatcgacccaggtggccggggcgatcgccgaaggcggcgaaccgggcatgcaacggaccaaggtcaaagccgcctacttgcgcaccgggctgtccgaagctcaactagccacggtttaccggcggctgaccgtctacggatacgacaaccctgcggcggcgctgttgctgctcggttacggcggtatggcgaatgccgtggctccgtcggccaccgcactcgctcagcgcgactcggttctcaaagcgctgttcgtcacgaactggtcggagcccgccgaggacgagcggcatctgacctggattcgcggtttctaccgcgagatgtacgccgaaaccggcggagttccggtgccaggtacccgtgtcgacggctcctacatcaactacccggacaccgacttggccgatccattgtggaacacctccggtgttgcctggcacgacctgtactacaaagacaactacccgcggctgcagcgggccaaagcgcggtgggatccgcagaacatcttccagcacggcctgtcgatcaaaccgccggcacggctttcacccggtcagccatgaggagctcatcacgatgtccacaacgcacgagatcgaaaccgtggaacgcatcatcctcgccgccggatccagtgcggcgagcctggccgacctgaccaccgaactcggactcgccaggatcgcacccgtgctgatcgacgagatcctcttccgcgcggaaccggcccccgacatcgaacggaccgaggtcgcggtccagatcacccaccgaggcgagaccgttgacttcgtcctgacgctacagtccggtgagctgatcaaggccgagcaacgaccggtcggagacgtcccgctgcggatcggttacgagctcaccgatctcatcgccgagttgttcggcccaggagctcccagggccgtcggcgcccggagcaccaacttcctccgaaccaccacatccggttcgatacccggtccgtcggaactgtccgatggcttccaggccatctccgcagtggtcgccggctgcgggcaccgacgtcccgacctcaacttgctcgcctcccactaccgcacggacaagtggggcggcctgcactggttcaccccgctatacgagcgacacctcggcgagttccgtgatcgcccggtgcgcatcctggagatcggtgtcggtggctacaacttcgacggtggcggcggcgaatccctgaagatgtggaagcgctacttccaccgcggcctcgtgttcgggatggacgttttcgacaagtccttcctcgaccagcagaggctctgcaccgtccgcgccgaccagagcaagcccgaggagctggccgccgttgacgacaagtacggaccgttcgacatcatcatcgacgatggcagccacatcaacggacacgtgcgcacatccctggaaacgctgttcccccggttgcgcagcggtggcgtatacgtgatcgaggatctgtggacgacctatgctcccggattcggcgggcaggcgcagtgcccggccgcacccggcaccacggtcagcctgctcaagaacctgttggaaggcgttcagcacgaggagcagccgcatgcgggctcgtacgagccgagctacctggaacgcaatttggtcggcctccacacctaccacaacatcgcgttcctggagaaaggcgtcaacgccgaaggcggcgttcctgcttgggtgccaaggagtctggacgacatattgcacctggccgacgtgaacagcgcggaggacgagtgaacagcagaggggcgaacacacaggcatttccgaccgcggatcaggtggagtccatcttcgatgcgttggcgcacgggcgtcccctgcaccacggttactgggcgggcgggtatcgggaggatgccggtgccacaccgtggtcggatgctgccgaccaactgaccgacctgttcatcgacaaggccgcgctccgtcccggagcgcacctgttcgacctgggctgcggcaatgggcagcccgtagtccgtgcggcatgcgccagcggcgttcgagtcaccggaatcaccgtgaacgcccagcatctcgccgccgccaccaggctcgccaacgagaccggactggccggcagtcttgagttcgatctagtcgacggcgcccagctgccctacccggacggtttctttcaggccgcatgggcgatgcagtccgtcgtgcagatcgtggaccaggccgccgcgatccgcgaggtccaccgaatcctggaacccggcggccggttcgtcctcggagacatcatcactcgggttcgactcccggaagagtacgcggcggtttggacgggcacgaccgcccataccttgaacagcttcacggcgctggtcagcgaagccgggttcgagattctcgaagtcaccgacctcacggcacagaccaggtgcatggtctcctggtacgtcgacgagttgctccggaaactcgatgagctcgccggcgtcgagcctgcggctgtcggcacctaccagcaacgctacttgggagacatcgcggcgaagcacggaccgggaccagcacagctgatcgccgcggttgcggaataccggaaacatccggattacgccagaaacgaggaaagcatgggtttcatgctcctgcaggctcgaaagaagcagtcctgatggcctccgagcacgccagcctggtcggcgacgatctgcgggcacccgcggatgatcccttctaccgaccgccgacgccgctaccgccgggtgtcccgggcacgctcctcagggcccggcccgtctcggcactgcgcggcacgggcgaacccgtcgcagccaaggcctggcaaatcctctaccggtccaactccgcccttggcatgccgaacgccgtctccggcaccgttctggtgccgaacatcccgtggccgcgcgaagatcgccccatcatcactttcgcagtgggcacccacggcctcggtagccaagttgccccgtcgtacctgcttcgaaccggaaccgagccggagaccgagctgatcgccgtggccctcgaccgcgggtgggccgtggtcatcaccgactacgaaggcctcggtactcctggaacccacacctacaccgtcggcagggcgcagggacacgccatgctcgatgccgcccgcgctgcgcaacggctaccgggctccggcctgacgaccgactgcccggtcggcatctggggctatgcgcagggtgggcaagcgtcggccttcgccggcgaactgcaccccacctacgcacctgaactgcgaatccgcgctgcggccgcaggtgcggtgccgatcgatctgctggacatcatccaccgaaatgacggggtgttcaccgggccggtgctggccggcctggtcgggcatgccgctgcctaccccgatctgccattcgacgagcttctcaccgaagcgggtcgtaccgccgttgatcaagtgcgcgagctcggtgcaccggagctcgtcacccgcttcctcggccgcgagctgagcgacttcctcgacacttccggccttttcgagcaacctcgatggcgcgcacgactggccgaaagcgtcgcaggtaggaacggtggcccggtggtccccacgctcgtctaccacagcacggacgacgagatcgttccgttcgcattcggcgagcgactccgggacagctaccgcgcggcgggtacgccagtgcggtggcatccgctctccggattggctcactttcccgccgccctggccagctcgcgagtggtcgtctcgtggttcgacgagcacttctccgagccgtccgcgatcagcggtccgcgagatgccaggtgagcggatggcggtgagcctctccagcggcttccccgctggcttccggatgcccggtcaggcttcgaggcgaactactacccgcggatgccgggcggctatgtggacccgcaccgacgggcctgaccgatcgcctccaccagcgcggcctgctggatcatcgattcgcccgaatctccggccaccgcagggtcgtccacgcctgtccctgctctgatgtcgcgtgcgaaggcggtgaccgccttgcgaacctgatcttccgctggcaaggacaactcgtcgacaacgcccttccgctcgattcggatcacggcctgccactcggcgggcggcgtgaacgcccggtcgacgacgattcgcccacgactcccccacagctcgtacgcgctgcggtagtggtgcacgaaaccgtatccgaggtgggcaacggtgccaccttccgattggagcagcacgctgcccgacaagtcgacgcccgactcctgggcctcgtgcgagcttgcgccgagaaccgtgagcggaccgaggagaaagtgccgagcggcacgggcgggatagacaccgatgtccagcaacgctccgccaccgagttcggtgcgatagcggatgtccgtgtcgggaagcggcggaattccgaacacggcggtgaactcccggagctcaccgatctccccggattgcagcaggtcgcggaccacgtcgtgccggccgtggtggaggaacaggtaattctcccgcagcagcaggttcttcctcctggccagcccgaccaggcgagcggtgtcggacgccgtcgtcgtcagcggtttctccgcaagcacgtgtttgtctgcctcaagcgccttgccgatccactctgcatgcatgccaggcggcaacggcacgtagacggcatcgatgtccggccgctccaggagccgctggtaacccagcaccgcctcgcattcgaatcgcgctgcgaaccgttcggctttcgccggatcacggctcgccaccgccaccacctctgtttcggccacgtcgcacatcgcgggcagcatccgtcgccacgcgaaggaagcgcacccgagcacaccgatgcgcaccggctttcgcatcgagctggtcatcgccccaacgcccacaagctatgcagggaggcgaccaagctgcgcgcctggatgttcaagaagtgggtgctccggagcagctcgcccaactgtcccaaagtcatccaccggaagtcgctgggaggtcgtgccgcgaagtcctcatgcacctcgatgatccggtacctgttctgcgcctggtagaaccgaccgccttcttcggacaggatcgattcgtaccgcacggtttcgggatcggcggtgagcacgtcgtccaagaacggcggccagtcgttcgacggggtgctttggtagttggccacactgcactggaccgtgggagcgatttccgcagtccacttatacccagcctccacccgagcgtggaccaaaccgtgcagcactccgccgatccgcttgaccaacagtgcgatctcaccttgttctcgcggttcgatcatcggctgcgtccagctggcgacctcacgattggtcgcggacaccgacaccgcgatcaccgcgaagtacttgccgtcctggtgggcgatctcggtatcggtgcgataccacttgtcgaccctgctcagcggaacgcgcgttgcccgcaagcggtagcgggccttggcttcctcgaaccaaccgaccgcctcggagatactcgacgaatcgatgccgtgcgagagcgacctggccaccgcctgtcggaagggctcctccgaggcggctagttcgggtccggtggcggaatcgtggaacgggatgcaagacagcaccgtccgggtgtccatgttgacgatgttgtcctgacgaaggagagccagcacctggccgagcgtcaaccagcagaagtctggcaggactggcacttcctcctggacttccaccaccatgttccggttgcgcttccggtagaaccaggacccctgttcagactggagcacgtctaccagcacgcggccgcggccccgcccgaggaagtagtccacatagggcggaacgctgccacggtgtgcctgcgtgtagttgctccgagttgcctgaaccgtcggcgagagctgcaggacgttgacgttgcccggttccatctttgctgacatgaggcagtgcagcacgccgtcgatctccttgacgagaatgccgaggatacctacttcagcctggttgatgatcggctggtgccagctgggtgccgcgccatagttggtctcgacctgcaggccttctaccgtgaagaacctaccgtcggcatgaaccaggttctccgtgctggcatcgaatttccatttcgacaggcggtcgaacgggatgcgattggtctcgaagctgttctcgcccagccgatcggcgagccagcagtggaactccgtggtcggaatcatgccattgcaagcgctcagcgcagagtcgacgaaccgccgcgtgttgttgctgccgagcggcgcagcagcacttgcctcagcttcgacagaactgctcatgcccaatccctcactgccgtgacgatgtgcacgccggctcccaggggcgtcgcggtctggtccagcggcctggcgaggatcatcgaagcgatccgcccgtaaggaccgcgagcacctcgtcctggcgttcggtcatgaagaaatgcccgccggagaagacacggacgtcggccacggcctcggtgtgctctcgccaggcttccgcctcatccaaggtgaccttcggctcggcatctaccaccagcacggtgatcgggcaacccaccttcgctcctggcgcacagcggtatgtctcgaccgcacggtagtcgttgctcagcgggcgccacgatcctcgtcggaaatcggttggagcgcaaacctctggggagatcaacaccccattggacgattctggacaagaatctgacttcgggactcgcctggcatcgtcccggtcacggcggaatccgagtcgacgcaacagcgatgaacacctgccaaaccccggcgtccatgtttccggccacacgttgctcacggatggccatcagactgcccagtgcggcggttctcacgttcggcaactagcttttccagacgtggaacgatgtcgtgcgggctgggactttcctcgatttcacggcggatcagcgccgcgttggcagcgaacgacggctcgtcgagcaggcgggccagctgacctcgcacgtcgtcttcggtaaacgtcgcggggtcgaggaccagaccggctccccgatcggctaggagctccgccctacgagattcgtcccagaaggtcccagggagaatcaactgcggtacgccgttgaccgtggcggtttcctgcgtcgtcgtcgagccatgatggatgatcactgaacacgactccagcagttcgttgagcggtacgtattcgtggacccggacgttcgagggcaactcccccatctcccgtacttcgtcgtcagacaaggtggcgatcacctcgacgtcgagcctggccgcgccgcgcaacaacctttccaccattgcttgttcctggtcactttgctccccgtactgttcggtcaccctgctcagccgccgcttggtcagcccgcgcgtgatgcagacgcgcggcttcgtcggtcgttcgcgcaaccactccggcaacaccgccggaccgttgtacggcacgaaacgcatcgagatgtagtccaagtccacaggcaggcgcatccaggatggaatcggatctatggtcgcttggcccgtcacgatctcttcatcgaacgtggctccgaacttggcgagcttcgctcccagccacgtcccgagcgggtcgacgcgctgctcaggcggcttcgattcctggtattcgaggaaaccggaccgcagccaccccgacacatcgagggcgacgagcatccgcacgtgtcgtgcgccgagcgctcgcgccacaactggccccgaacacaccatagcgtcccacacaacgagatcaggctgccatttctcggcgaaccccatgagatcgtccagcgatcggtcatccacaaggtggagttgctccacggcgtccgtgtctctgccggagttgattgacagcagctcgtcgaagagttccggatgccgccccttctcgtcgaacgagaccccgctgccgagaacgagttcgttcttggccgccaaggagatgaggtcgagctcgtcgccgacgggaaccgcggtgagtcctgctccggtgaccatcgacaccatattcgggcagatggcgacacggacctcgtgccccgcggcacgcaacgcccacgccaacggcaccaggttgaagaagtgcgaactcgccggcagcggggtgaacaggacacgcatgaactctccgatcgcaattgaacacccgggaagcatgccaagaatcacagaaatctctgatatcccccgggaaacgccgctttcgcaagccaaatcttaggccttccaggtgatggtagcgatcttgacaagcgcgagcaggtcgttcccgctagcctgggctctaccgagtcgggtgtgccgggtagatcgaggatttctgagtcaatgagcgcttctccttgctccgctgtcctgatgtcccgcaccgcatcgaaccagggcaggaaggtgtaaggcgccgagacagcacactgtcccgctgggacgtcataacgcgattcgccacgggcatcgctcatctcctgaaggcaaggcgcgaagactgatcgtcgcctgcatgcagagccggaaaaccagagcgctggggaaagggcgcgccagagtgacttcgtgtgacgacacttgcgctaccgctactgagatggtgccggatgccaaggaccggatattggcatccgtacgcgattaccaccgcgaacaggaatccccgaccttcgtggctggatcgacgccgatccggccatcgggcgccgtgctcgacgaggacgaccgggtggcactggtggaagccgcgctggagctccggatcgccgcgggcgggaatgcacggcgattcgagagcgagttcgcccgcttcttcggcctccgcaaggctcatctcgtcaactccggttcgtcggccaatctcctggcactgagttcgcttacctcccccaaactcggcgaggcacgactgcggcccggcgacgaagtgatcactgcggcggtcggcttccccacgacgatcaatccggcggtccaaaacggactcgtcccggtattcgtcgacgtggaactgggcacctacaacgcaacgccagaccgcatcaaggccgccgtcacggaacggacgcgagccatcatgctggcgcacaccctgggcaaccccttcgccgctgacgaaatcgcggagatcgcaaaagaacacgagctgttcctcgtcgaagacaactgtgatgcggtgggatccacctaccggggacggctgaccggaaccttcggcgacctgacaacggtcagcttctatcctgcccatcacatcaccagcggcgagggtggctgcgtgttgaccggcagcctggaattggctcgcatcatcgagtcgctgcgtgactggggacgggattgctggtgcgagcccggcgtggacaacacctgccgcaagaggttcgactaccacctcggtacccttccaccgggctacgaccacaagtacacgttctcccacgtcggttacaacctcaagaccaccgacctgcaggccgcacttgcgctgagccagttgagcaagatttccgcattcgggtcggcacgccgccgtaactggcgacggttgcgcgaagggctgtccgggttgccgggcctgctgctgccggtagccacaccgcacagcgacccgagctggttcgggtttgcgatcaccatcagtgcggacgccgggttcacccgtgccgccctggtgaacttcctggaatcccgcaacatcggcacccgactgctgttcggcggtaacatcacccggcacccggccttcgagcaggtgcggtaccggatcgccgacgcgctcaccaacagcgacatcgtcaccgaccgaaccttctgggtcggcgtctacccaggcataacggaccaaatgatcgactacgtcgtcgaatcaatcgctgaattcgtggccaagagttcctagcatccagcatggcggcatctcggaggatttcagcaacgtgatcaacctgcaccagccgatcctcggcaccgaagaactcgacgcgatcgcggaggtgttcgcctccaactggatcgggctcgggccgcgcacccggacgttcgaggccgaattcgcccaccacctgggagtggatcccgaacaggtcgtgttcctcaactcggggactgccgcgctgttccttaccgtgcaggtgctcgacctcggcccaggcgacgacgtggtacttccttcgataagcttcgtggcggcggccaacgccatcgcatcctccggtgcccgcccggtgttctgcgacgtcgacccccggacgttgaaccccacgctggatgatgtggcgagggccatcacgccggcgaccaaggccgtattgctgctccactatggaggatcgccgggagaagtcaccgcgatcgccgatttctgccgtgaaaagggcctcatgctcatcgaggactccgcctgcgcggtggcatcgtccgtgcacggcaccgcttgcggaacctttggtgacctggccacgtggagtttcgatgcgatgaagatcctggtcaccggggatgggggcatgttctacgcggcggatccggagctggcgcaccgcgcaagacgactcgcctaccacggtcttgagcagatgagcggattcgattcggccaagtcttccaaccgctggtgggatattcgcgtcgaagacatcggccagcggctgatcgggaacgacatgacggcagcgcttggcagcgtgcagctgcgcaaactgccagaattcatcaacaggcgtagagaaatcgctacgcagtacgaccggttgctttccgatgtgccgggtgtcctcctaccgccgacgctaccggatgggcacgtctcgtcacactacttctactgggtccagctggctccggagatccgcgaccaggtggcgcagcaaatgctggaacgcggcatctacacgagctaccgctacccgcccctgcacaaggtccccatctaccgcgcggactgcaagctgccttctgcggagcacgcctgccgcagaacactcctgctaccactgcacccaagccttgacgacgccgaggtgcgcacggtggctgacgagttccagaaggccgtcgaacaccacatcagccaaagatcaccactccgaaagtgaggatgtcgcgcgtgagcgacacattcgcagaaacctcctcggtatacagcccagatcatgccgacatctacgacgcgatccactccgcgcgtggccgggactgggcagccgaggccggggaagtagtccagctcgtacgcaccaggctgcccgaagcacagtccctactcgacgtcgcctgtgggaccggggcgcacctagagcgattccgtgccgaatacgcgaaggtcgcggggcttgaactgtccgatgcgatgcgggagatcgcgatcagacgagtccctgaggtaccgattcacatcggtgacatccgcgatttcgacctcggcgagccattcgacgtcatcacctgcctgtgctttaccgcggcttacatgcggaccgttgacgacctgcgacgcgtgacgcggaacatggcccggcacctggcccctggtggagtcgcggtcatcgaaccctggtggtttcccgacaagttcatcgacgggttcgtcaccggagccgtcgcgcaccacggcgagcgggtgatcagccggctatcgcactcggtcctggagggccgtacgagccggatgaccgtccgctacacagtcgccgaacccaccgggatccgggacttcacagagttcgaaatcctctcgctgttcactgaggacgagtacaccgccgcgctcgaagacgcagggatccgcgcggaataccttcctggagcaccgaacggccgaggcctgttcgtcggaatccgcaactgagcccggaacaacgacgcaagacctggctgggcaggccccgggactcactcgaccgataagccgacgtgacccgggatcacttcgatcgtctctgatgccggcaagttttgaccgtcgtgatctaggtgccaaccaggtcgacgaagccctgggccctagccgcgatcgtcggcaaggtcgccgaggacgatcccgcctcgaatctgcgaccacctcgccgcagctgttccggcagacgttgtgatccgagccgacgagaaccactcggttcagcccggcacctgcggctgggaggtgttcggctcctgagcagccccaaagcaccggccatcggcgaagaactcgaccggctcccgcgccggatgcgcctacccgacctacgcaaagccgcacccgccatgctggcaaccgcccacgcctgacctaagccgccggtgagccacggctggcccagtgtcgccaggcaaccgcggcgcaccggcggtaacggcgcccgaagtacaggttgtcaatgaccgagacggcgaaggccgacatccgtacccacaggaacaggtgttgttcggcgtacccggtcgcagcgagcctctccgacttcgattgcaccatcgccgactgagcgcctcaccagggcacattcccggcgtcgtcgaacatgcctccggtcgggccgtcgtctggcagcgtggcgagccgaatggcgatcctggcaccgtctgccggcgtgctggttccgtggaagccgttaaggtcggtcgcgacgtagccggggcaggcgttgttgattttgatgttggtatcgctgagttccttggcgtactggatggtgatcgcgttgaggaacgtcttcgacggtgagtaggctccgctgatcccgccgaggtcgacgcccggcgtggtttgcaaggtcagggaagcgacgtggctggactggttgacgatccgcgggcgctcggagcggcgtagcaacggcagcatagcgttggtaacccgaacgacgccgatcacgttggtctccaccaccgcccggaggctcgccggtgtgacggtcgagggctcctccggccatgccccggcgatgccggcgttattaaccagcacatcgagccggccggcgcgctcctcgagcagagccgcagcagccgcgacgctcgcgtcgtctgtcacgtccagggataccgcgaacgcatcgacgccgtccgcacgcaatttcgccacggcatcctccccgcgctggtggtcccgtgccccgattccgacgctccaccccagcgcgccgagcccggccgcgatctcgtatccgattcccttgtttgcgccggtgaccagtgcaatcgtctgttcgctcatgctttctagcgtggcccgaaaccggcggggaaccaacaccatctaggtctcacaccgatacccagctgatatgaatcagcggtaggctcgacggatggagacgcgggagttgcggtacttcgttgcagtcgccgaggagttgcacttcggccgggccgcccagcgcctgggcatcgcccagccgccgctgtcgcggacgatcgcccagctcgagcaacgactcggagtcgtgttgctgcaacgcaccagccgcaaagtctcgctcaccgaagccggggcaatgctgctgaccgaaggccgggcgatcctcggcgcgctggcagcagccgagcgacgcacccagcgtgccgcgacgagccagccctcgctagtcctggctgccaaggccggcgcctccggtgagctgctggcgaagttgctcgacgcgtacgccgccgagccgggagccgtggccgtcgacctgctgctctgcgaatcccagccccagaaaacgctgcatgacggccgggccgacgtggcgctgttgcatcaacccttcgacccgacggccgaactcgacatcgaaattctgaacaccgagcaacaagtcgccattcttccgacctcgcatccgcttgccagcgagccccatgtacggatggcggatgtcagctcactgccggatctcccgcttgcgcgctggcccggccccgacggcgtctatccagatggccccggcgtggaagtacgcaaccagacgcaactgttccaaatgatcgcactcggccgcactaccgtggtcatgcccgaatccagtcgcgtcaacctgctcgaaggcctcgccgccgtaccggttctagacgcgccggacgtgacgacagtcatcgcctggccgccccacagccgctcccgagcactcgccggcttggtccgcgtggccacactcctctaaatcttcgctccctcaattgcccgcagctaggacgaatgccgtgcgactgccggaaacgaccgcgcgcaacacctcatgtgcctcagcgggagaagacgctatgcggatgccgcagagacctcacggccgtcccgtcgccaggagccagcggtcccgttcgagctggtaggtttcggcgatctgctccgtgacgcggtcgatgtagccgaagctggttgcgagcattcgttgcgtggtcgctgcggatacggcctcgtcggcgcattggcggcggatctcgtcgaggcatcactacaggaagcggaagtgcccgatgcggttggccctgatcagcgcgttgatggaaatgtttcgccagtcgtcgcggatactccaacaccgcagcaggacccggcgaatatcccaacggaatctcgaattcgagaacgtgcggcaatgtggcgatattttcctcaacactcgtccgtagaatgctgaggacgatctcatcggctcgcaactgcggagcctcggtaatcaggtgcgtgtagacgtctcggctgacttccgagacgcacgacgcgacgctcgatgccacggccgcctgtagcttcgaggaatcgaagctgtccgtggccatgacacgacggtactgcggcgggagcagaagcagcgcttcctgcgccgatggcgcgcctggagaagatcagcaccttcggcctgaccgagccgggcgcacggcaccgacgtggtccagctggagctcggagacacagcgtggcggtgttcagcgccgccaggtcccgcagccagcgctttggcgtgcggcgcttcgggagagctgggccattacaggttgtgcgagagcagctggctcagcacctcgtcgacgttcatccaccggtgttcatcaccaggttcgaccacgtcgtaggtgtcgttcaagaagtccgcaagctggtcagcattcacctcgaaggaggcctgccccgacggcgagctcatctcgatcacgaccaaccccggaaaaccccgtcgagggccgatccgcacatcgccttcgcctgcctcggcgatcagcccgtcggccagcaggtcgcgggcgatcacccagtccacctgaccgtccgtgcctacgttgagcttcatggagatctcgtacggattgcggctgtcgtaccgcagctccacgccgactggcgcgatcacacccgccggggctaccaggttgaagatcatggtggcgagcaccgtgccgtgatcgtttgccatgatgtccacgctcccaagccttggcttcccataccctcataacgaagcatgcccaacccgggttcataccttcttcacgaagtcttcagaccctggtggcagtccccctcgggctcccagcgaggaaccttcactcacactgaacccacgggactctgggcccggaactcccgaagctgacccaaggtgcaaagcaaccggcgagtagcttttcgctgcgccagtcaatcaatgacggctccgggaatgtctcgtgaccatgctagggcgtactcgccgaaaaatgggatggatacgggctgaccagcaggaacgcggtcagacggtctggtcctcgggaaagaatcgggcgggtttgtctggcgcgggcgtcaggactggtccaaggcccgttcgatcgcgcggcgggcccggccggcggccgcccggtcgtgctggagctgcatggccgcgttcagtgccagcccggtggcgacgatctcgaacagcgcctggtcgatgtcgaacccggcgggcagctcgccgttctccaccgccgcggtcaggtccgcccgcagctgtccccgccagcgcgaccacacctcggccaccgcgtcgcggacccggccggggcggccgtcgtactcggtgagcgccgcggtcatcaggcagccgccgggcagcagtggcgcttctaggtagcccacggcgttggcgcacaccgcgcgcagccgccgcagacccggcggctcggccagtgcgggctcgaccacccggtgccagaagtccacgaatgccttgtccagcgtggagatctgcagtgtctccttggtgccgaagtgcttgtgcaccccggacttgctcatctccagttcctcggcgagccggccgatggtgatgccgtccagcccttcctcggatgcgatctcggcggcacggtcgaggatccggctcctggtggcctgtgcttcggccgctgagcgtcgcggtgacatgtgacgaggatagcgtacgcgcgttcgctattgatttagtgaacgtgcgtacgctaaattccgcttcacccacggaccgaaggagtgcgagatgcgggtgcgacgactgggctgggccggactggaaatcgaggcgggcggcaagcgactggtgatcgactacgtacgggacctctcaccgctgttcacggcgtggaaacccggcgagaggctggcggtgccgagcgggacggtcaccgccgcactggtcacccacctgcaccgggaccacaccgacgcggccgcgctcgcggccgcgctgacaccgggggcaccggtgctccgacccgcgcccggccacggcgacgacgtggacaacgtgacgacactgccggccgagcgcgagctgacactgcaccgactggctgccgaggtcgtggatgcctggtccacccgcgacctcgggccgttccgcgtcaccgcggtccccgccgtcgacgggctgggcgacccgcagctgaactgggtggtgcaggccgacgggcagcgggtcttccacggcggcgacacgatgttccacggctactggtggctcatcgcgcgccggttcagcccgttcgacgcggtgttcctgcccgccaacggcgcggtggtcgacgcgccacacctccagccgccgagcccgctgcccgccgcgatggacccgaggcaggccgccgcagccgcagagatcctcgacgcccggtacgcagtgccgatgcactacgaggcggaacagccggacaagatcgcgggctacgtcgaggtctccgacccggagaatgagttccgcacgcacgccggacaccgcgcacacgtgctgcccatcgaggaatggctggacctggccacttgaggcggaaactccgccgcgccggcgggctcaggtcgcaacagaacctaggtccgatggatggtccggaatcgcgcgggaatcggttgctccaagacactctccggtcgcggcggcgtcaatcacaagattcagcatccattactgctggaaaccacgatcaaatgcgacactccgggttgagccgaacccacgggtccagtcctggtcctgggcgggacggacccttgggttcccgccgaggaaccctcacttgcgctgaacccacggcggccgaagcgtcccggtagcagacgccggaaaccagcgcttagctctggaacgctggctgcggaccgggcccagaggcgagcgctcggtgggtgctgagttcggggacgtacttgtagatcgtcgagcggaagacgcaccgcacgcttgagcttgaacggcgcagcacgcgacccgcccgagataccggttagcgtggtcagatcaacactgcccgttgtgcaccattagccgcatatgtccggttaccatcgattcgatgcggatccggtacgtgtcaaagctctctacgtcgacgggtacctgaatgccgcgctcaacgacgcgtcatccgggtcagcccttctcgagcaggcgagcgcgctggcggcggagttgggcgaccaatcaggggcggcctacgtcgcgcagatctcggggctcaccgccctgttcaacgaagatccggcgcgggcgagcgcgctcttcgaagacgctctcgccaagcatcggctgattggcgatcacgctgccgccgcctacgatcagatcgagctcgcgttggcagtcgcgttccttggtgatcatgagcgcgccgctgccctgttccgcgggtgccctgccgtcaaggagacctacagcgaacagtggatgagatcgcttgccctgtgggcgaagggaatagcagacctactagcgggcaattaccggcaagccaatgctgcggaactggagagtcttcgcctgcggctcggcttccatgagcagtttcagatcgcgttgtgcgttgagattctggcctgcatagccagcgcagacggtgacccggcacgggctgcgaccttgttcggcgtgtcccaaacgatcaaaaagaacgtcgatgcgtcgctcgccggccacaaacatgttgcgcgcctacacgaccactacgaggcagtagcacgtagctcactcggcgacgagacgtttcagaaaggcgttcaccacgccacacagctcgacttcgacgaggccatcgcatggatacggaatccgggcaaagccggggaaccagcaagctccaggacggaagaaacgcacgcgtcggtgcttactccgcgcgagcgagaggtagcagcgctggtcgcacagggcaccaccaacaaagaaatcgccgccatcatggtgatctcccgccgcaccgctgaggcccacgtcgagcacatcctgaccaaactcggcttcaccactcggacgcaaatcgcgacctgggtcattcaacagaagaccgcgcgacgatgcgactgacaaccgccggttttcggattggcgtggaccagtagaagctgccccgtctgcgagacggcccctctccacagcctcttctccacagtcgatcaacgaccgaacgggaccgcttgaggacggcatccgatgcccaccgcgcggagaggagcacttggccatgcgcacactgatcgagaacgctgccgtggtgacgatggacgacgttctcggcgacttcgaacgagccgacatcctcgtcgacaacggtgtcatcgtcgagatcgggccgaacctcaacgttggcgacaccgagcgaatcgacgcctcgtcgatgatcgccatgccgggcatggtcgacacccatcgacacacctggcaaaccgggctccggggcattctggcggacgggaacatcctcgactacctgaggggattccggctgcagatggcgacgaagtaccgcccgcaggacatgtatgcgggcaactacctcggtggcctcgattgccttaactcgggggtgaccacgctggtcgattactgccacaacatcgtcaccggcgagcacgcgcacgccgcggtcgctggactccgcgacgcgggcgtgcgcgcgctgtacggccacggcctcctgcccatcacgtcgaacacgtggtccgagaccaaaggcgggctggacgagtcggtggaagaaggcgacttcgcccggcgggcgcggctggcccgggaaatccgcgcccagtacttcccgagcgagcaacaattgctgcgcttcggcatcgccccgcaggaactagccatcgctcccttcggggacgtcaagcaggaattcgagctggcccgcgagctcggcgcacgcatcacgttccactgcaaccaagtcatcgcgcgcaacctgttcaaggacatcgaggcgctgcactcccacaacatgctcggcagcgaccttctcttggtgcacgggacattcagcactgagaacgaatggcacctgctgcggggtaccggcaccatgatctcggtttgcgccgagaccgagatgcagatgggcatgggattcccggtcattcgtgaggccaccgagaacacgccggggccaagcctcggcatcgactgcacgagcagtacctgcggcgacatgatttcgcacgcacggctcgtcctacaggtgacccgatggagggacgatcaagaagactacgcgcggtcgacactgcccacggtcatgcggtggaaaacgcgcgacgccttacggtggctcacggtcaacggtgcccgcgccgcgggcgtcgacgacgtgacaggaaccctggcaccgggcaagcgggccgacatcgtattgctggacatgtcaggcatcagccaggccggttggaaccgccacgacccttgtggcgcgatcattgcgcagaccaactcgggcaacgtgcacacggtgctggtcgatgggcgggtggtcaagcggaacggccggctggtgcacgtcgacgtcaacggagcgcttgcaacgctcgcggagtcgcacggtcatctctacgaccaaatggcccagcacggcggattcatcccgcaacctccagccgagctaccggtgttcaaccgctgagaaccaagccagctgtggctggcgcgccattcgctgcgtgaggtgacccggctggccgggctcgaccggaaaaccgtcagacgctgctgtgtgacctgcacggacgaggttatcggcataggcaaggccagtcgcagcagcacggtcgctcatcatgccgcgcccaccgtcagccgcgtgcgagcgccgattcgagcaaccacggccgggcccctggaatagccgcttccacctgcacggagcaggtattcgcctcgtggaccgatgatcgtccccgtgaacgcgtggggctgccgtgcgggaacgcgccgtcttccggggggaaggcgggctgcgggaaccggcgttgactgaccactcgtgcgcattcgagcatcagcggccacatcaatggggagggcccggtgacgacaaagaccgtcaggtgtggtggcaggacgcggtccgaacgcaccgtgaccgttgaacggtcggccgagctgtcgtttcttgccgcagcaacagcaactcgacgaacgcgccggcgatcttgccgcgccggggccaccaaccgcgaactcatgacccggctcaacacatcaacccagccccgataacagggttcgagccctgcctgtcgactcgtggcaatcgccctaaaggagggccagctgtggttacggatcgtgttcgcgtgctcctttgtgaagcgggcgtgagtgagttcatagagcccgcgccgcgttcgtgagtaagttcttgaacatggagaacggcggacccagccggacagcgctcgctaccgcgtacgcccgcgcctatcaccagatcgctgaccgaccacagatcttcaccgaccccctggcggtacgtctgctcggcgtcaccgcagaggaactgaccaaattggccacgcccacaaccgatcacctcggcgccggggcaatcgatcagccccgccgcctgttcttcgccgcccgtgcccgcttcgccgaggacgccgtggccgcggccatcgccgatggtgtacggcaggtcgtgatcctcggcgcgggcctggacaccttcgcctatcgcaatccgcgcccggacttgcgcgtcttcgaggtcgaccaccccgccacccaagcatggaaacgcgaacgccttgctagcgcagggatcgaccgccctgagacgttgaccttcgtaccggtcgatttcgaaacccagccgctggcaactggattggaatccgccggattcaaacggacggacccggcagtattcgtgtggctcggcgttgtcttctatctgaccgcgaacgccgcccacgccaccctcgaatacatcgctggtcaagcccagccggtcgaggtggtcttcgactacctgcagcctgcggccaccgacgaggaccgtgcgcaccagcgggcacgtgccgatcggctggccggcgccggcgaacccttgttcagctacttcacaaccgacgacatcgccgcacagcttcacgccctcgggttcaccggcatcgaagaccactccgccccggacctcatcgccggctacctccacggatccgcaggtttcgagggcgaaccaccccgcgcactgcgcgcgagccgcatactgcacgcgagccgctgaggtttgcctgccgcgcctacttggaccacatctgtcgcgacggctagcatctcccacatcgtcctctgaactgcacaaactcaaaaaatcgcgggagcgcacgcgggtagggccccggcgaacaagccctagcgatacatcactttgaacaaggtcgcgtctcgataggctgccaatgcgccgttgcgtttcgcgcgaaccgcgcggtcgacttggtcgtggcgtagtcaaggaaccgctgcagctcatcgcgggtgaacgggcggtcgtccggatcgccctcataggactggagatgggcgagtgagttccactcgtgcacattcgccaccgggtactcgtccggcccgaacgacgcctcgcacgccagcgcccagccataccggctgtcacagaggaattcgttgaacagcctgagactgccttggtaggcgcggattgtggatggcgcgagatgccgttctccggtcggtgattgcgaccattcgtccacatgcgacggtgtccaccgccacggatactcgttggtgaactccgcgaaccggcgcaccagccgctcccgcaccccggccaggtgcgggaacattgccttgatcaaaccgcagtccagacgatcatgatcaacgagtgtgatcaccagcagtcactggagccggcgttgcgtccacacggttggccaacccgagcaggtgggtgcacagcaacgttgttgaagcacaacgcctgactggttcaggtccggcggcagcccgtattccagccgtctcggcgcggggacgttcgtgttcagagataaaatcgtgttgcccggttggtcggtttgggcggttttgagtccgtgcgaggccgattatgcggcatggggcctgtgttgaggaggtgccgtggttactacgcagcggaaaccggcgggtgctgggggaacgacggtgagtctgccgggcgtaacggccgagttccaccgtcccgatcactacattcccactcgtgatgatcttgctagcgcggctgaggccgttcggggcgttctcccggaccatcagacgatggccttctatcgtggtcttggagcgctgaccctgttggggttgatggactggccggtggcggcggcgattggcgtgggtgtcgcggtcgcgcagcgtgccggcggaccggcgtcgaagtgatccggtttgtagcgggttccgggctaggcgtcgctgagcgcgccgcggcggcgctcaggccaggtgaacctgggtaggtgttgcgttgcctgcgtccggcgtagctgcatgctcggagccgtttcgaagaacccgagcacacaggcggccttgaattcaccaccgctgggactactggtgtgtcggcgggtcgaacagcgtggcgaagccgtcggtgttgctgatcagctcgcaggccaccgagaggacggatgtgcggctgtttcgaggttcgctttccgctcgtcggtcctacgctcgtgactcacggtatctgtgcgcgcgggaggtagtggtggctaggacggcgcggaacacaacgcctggcgcaggcgcgcggcaacaaggggcgcggttgcgagccgcggcggtcagcctgcccgtcgtggcacagtttcgtcgggtcgatgttcgcatgccgggtcgttgggaggacgcggttcgcgcggtacgggtcggttgggggctcgaatggccggttgcgggggcgaccggcgcgggggtgtcacgggcgtcggtcggctttgcgtcggacagctgagtgtgttcgatgctgcgtaccttgggcgcgttggcctcgcagatcgtggcgccggtggtggctgtcgcgcagagcatcgcgggcttggggcgcgggcggcgggcgtggtcgtcggaggggcgtgcgtacgtcgaggtgcgcggtgttgaccagccgggggctgaggaggctggcgagcagatcgcccggcggttggagaaggtgccgggtgttgcgtgggtcgagatcaacgctgtcgtggggcgggtggtcatcgggcacgatccgggcctggttggggtcgctgagctggtgggtgtggtggaggacgcggaggcggacaccggtttggacgaggaaccgttcgctgcggtcggtgtgagccacccggacaatccggtcaaggtgatcgctgaggcgacggtgctgggtgcgaacttgaccggcgctgtgatcgcggtgggggcccggatgctgccgctgcccgtgctgccgccgtctgttccggcgctggtgtcgaccggtgagtcggcctcctgggtccgggggccgctggaaacgcggatcgggaagaccgccactgacctgttgttcgggtttagcagtgcgttggggaacacgcttgcgcggcgtccggcgagtttgctggcggaatcggggtaccggttctgcctgttgcgggagacgcaggcggcgcggcggagctgggcgcggtgggaagccggaacgggggcgcatcctgccagtcaccgtagtgcgccggtgggggttcggccgcgtcctgtgccgttgcccgccggcccggtcgagcgcgccgcgaacggttcggctctgggtgggccggcggcgttcgcgggcatgctcggggtgacgcggagttttcagcgtgcgcaggcgatggtggtcgcgggcgcgccgcgcgcggcgcaggtggggcggggcgcgttcgcggcgcagctcgggtacgggctgtcggagcggacgactctggtgttcgatgcccgggtgttgcggcggttggaccgggtcgacacggtggtgatcgacgcggacgttctgcgcaccggtgctcggttggtgcatgacgtgattcccgcggacggggggcgcgcggtcgtcgagttgtgggaacgtgcgcatgaactcgtgggtgtgaccaagggggtcggcgcgcagcgtgatggttggtcgctgtactcggtcgctcggtcgcggttgcccccagacgtgcgcgaggtggccggtcggggtatcgaggtgttcgcgctgcgccacgattcgcgcacggccgcgtgggttctggctgccgaggagctggatccgctcgctgaggagttggtcgcggcagctcgcgaggtcgggtcggtggttctcgcgggtgatgggggccggttggcggggcggatcggtgttgatcgcgtggtcccgggtggggtgcggctggcttcggtggtgcgggagatgcagcgggagggcagcgtggtcggtgtggtgtccgcgcgggcgcgggcggcactggcggctgcggatgtcgggcttggtgtgacgcgtggtggtgaggttccgtggggtgcgcacctgatctcgggcgcgagcctgggggagtcgtgtgcgttgttgagtacggtcccgaccgcgcgttatgtcagcgtgcgtagcgcgcagctgtcgttgatcggttcggtcagcggggcggtgttcggcgcgttcgggcctgccatcgggagccaggtccgtgcgggcgttccggtggccgtgtgtgcggcaatcgcgctcggcgctgggacgtggtgggggatgcaggccgcgtggcgtccggttccgcgcgcggtgccgcgcactgcctggcatgcgatgggccccggcatggtgctggagctgctcggcagttcatcgcagggtctgaccgatgatgcggcgcacgagcgtttccaaggtcaggacgaggggacgggccttcgccggatgggtgtgttgcgggcgtcgctggaggagctggcgagcccgttgacgccggcgttggcgggtggggccgcgatctcggcgagtatcggtgccgttgcggacgcgacgatcatcatgggcgtgctggggatgaacgcgttgatcggcggcgtgcagcgcatcaccgcggaccgcgctttgaacaggcttctggaggccagcgttgttcgggttgtggtgcgccgtaaggaaaatgtgacgcagttgccggctgacgagctcgtgctcggcgatgtggtggagttggtggccggggatgctgttccggccgactgccggcttctggaggccgacgggctggaggtcgatgagtcgagcctgaccggggagtcgatgttggtcaccaagacggtgacggcgactccggcggtgccggtcgcggaccggacgtgcatgatctaccgggggaccgcggtcgctgccgggcgggcggtgggtgtcgtggtcgcgaccggcgcgaacaccgaggcaggcagcgcgatcgggcccgatgcccggcgaggtgccgatggtgtcgcggctcgcctgcagacgctggccaaggtgacggtgccgatctgcgtgggagcgggtgggattctgctcgtcacggacatgctgcgtaggcgtccattggggacatcgctggggcgggcggtgagcctggcggtggcggccgttcccgagggattgccgttcgttgccaccgtcgccgaactcgcggccgcccggcggctgtcgaaacgcggggcgctggtgcgtaactccgcgacgatcgaggctttggggcgggcgcaggtgttgtgtttcgacaagaccggcaccctcaccgaagggcgcatcgcgctgcggcaggtatccgatggcgcgtcgagccggtggctcgaggaaatctccacagtggaacggcgagtgctcgcgggtgccttgcgggcaagtccgttggtggagaacggagaactgctcccgcatcccaccgatcgcgcggtcgtcgatggcgcgcgtggcgcgggagtgcacccggccgaaggcaagcagcgctgggtaccgatcgacgagatgcccttcgagccttcccgtggctaccacgcggtgctcggcacctggcgcgacggcaatctgctgagtgtgaaaggtgccccggagatcgtgctggcccagtgcacccggtggcgcagatcagatggcgacgtgccgttggaggagaccgctcgtcgaggcgtcgagcgagttgtcgaaaacctcgcccggcagggctaccgggtgctggctgtcgcggagcgggccgcctcggaccgcagtgatctcgacgagtcccggatccgggatctgcggctgatcggtttcgtcgcgctggccgacccggtgcggcccactgcggccgccgccgtcgcgcagctccagcaggcaggtgtcgaggtcgtgatggtcaccggcgaccaccccagcaccgccgaggcgatcgccgccgaactcgacgcgctcaacgagcgtcgcgtcatgaccggcaccgaactggacaccctcgacggcgaccaactggcggcggaagtgaccaccgtcgcggtgttcgcgagggtcagcccggcgcagaaggcgcgcatcgtcgacgccctgcaacgcaacgaccgtgtggtcgcggtgaccggggacggcgccaacgacgccccggcgatccggttggccgacatcggcatcgcgctgggcgagcgcgcaacccccgccgcccgcgaggccgccgacctcgtggtcaccgatgaccgcatcgagaccatcgtcgacgccattgtggaaggccgcgccatgtgggcatcggtgcgtgactcgctggccatcctgctcggcggcaacctcggcgagatcggcttcaccgtcgtcaccggtgtgatcaacggcgggggcagcctcaacgcccgccagttgctgctggtcaacctgctcaccgacatcctcccggcgatggcgatcgcggtgcgaccacccccgacgatcactgcggagatgctgctggcagaaggccccgaagcctcgctgggcgctgcgctgacccgcgacatctaccgccgcgccgcggtcaccgccggggccgccatttgtgcgtggatcctgggcagggcgaccggaaccctgcgccaggccaacacggtcgcgctcgtggcgctggtcgccgcccagctcggacagaccctggtcgtgcgcggacggacaccactggtcatggcgtgtgcgcttgtctcgttcgtggcactggccgctgtcgtccaaactcccggcctgagccaattcttcggagccagcccgctactcccacacggctggatgatcgccgctggcgcaacgaccgccgccaccgtcatcagcctcttgctccaacaatggtgaacctccatgcatgagcgtcaagatcccttcaccacagccatcgtcgggcccgactcgggacaacttcgagcaggcaagacgttggagcgccgagagcggtgaacgactcgccagcggcgaaagcgcctgcccccagccgacgggcggtggacccacaatgggagctgcggcgacgtgcatgcggtcggtcatcaggatctctgtcgtgagcccgtccggatagatgaccggccactgcgggtaggactcggcgatcactaggtcgtagtcgtcgacctggagaccctgaagagccgcatccggctcggcttgaacaatcaccacatccagtcctggacgccgccggcgtagacgagtcagcacctcggggaacaggatgaaggtgacggtctgcatggaggccacacgcagacgttgcgagatctcgccacgtgagcgattgatctgagtgcgcagcgtctccagctcagcgatcacccggtccgctgcctccacgacgagctcacctttcgccgtcaggcggacgcgacggccttcgcgcaccagtagcggagcggatgccgcccaccgtgccgccgcagctggcccgccgcataaccgccagcagtggcctgaccagtgccaacatcgcccacacgggcccggtcggcgaccttgatcagtggtacaggctgggcaggccagcgggcaacgcacgccctccccgcacccaccacgatcaacatcggccgagatcgtaacgaaccccgtcggtgggttcgaagtggttcgaacagttgttcaagctgtaagtgcgctgccagccatgaccgggctacaataaaacgctagttctaccgaggtgcggtgagtcgtgtctggggttgcggttcgggaggctggtcgcctcccatatgaggtgacgagctttgtggggcgccgtcaggcggccacaagagttaagcgcgcgctgtccagttcacggttagtgaccctgactggtttcggcgggatcgggaagtcccggctggcgctgcacgtcgcacacgacgtgcggcgggccttctccgccgggacatttctggtggagctggctaacgttcgcgatcccatgctggtgccgcaggcggtcgcggctgctcttgggatccatgaccgttcgacacgtgccccggaggccgtgctcgtcgattacttggcggacaagcaagtcttgctggtgttggacaactgcgagcacctgctgggggcctgcagccgcctagtcgctgtgctgctggccgcggccccgcggttgcggatacttgcaaccagccgagaacatttagggatagtggcggaacagacctggccggttccgccactgtccgtgcctgctggcagcgattcatcaacgtcacaacaggaaggtcgtccctaccagcgtgaagcgttgaccttgttcgagcagcgtgccgcggcggcgctaccagggttcaccatcaacgaagaaaacgaacagatcgtggccaggttatgccggaggctggacggcattcccctagcgatcgaactcgccgccgtgcgcgttcgcgtgctctcagtcgggcaaattctaacgcgaatggagaaccgattccggctgctcaccaccggcgaccgcgccgacgatcctcggcatcagaccctgcgcgccgccgtcgactggagctacaacctgtgcaatgagcatgagaagcagttgtgggcgcgctgttcggttttcaccgacgaattcgatctcgacgcagccgaaaacgtctgcaccggcgacgggctgaccgatgatgacgtcttcgccgctctcgcgggactgatcgacaagtccgtgctcacccggaccgaggagcgcacgaagacgagataccggatgctggagactatccgtcaatacgggcacgaccggctcaccgaggcgggtgccgaaaacgctctgcgctgccggcaccgcgactactacctgcatctcgccgagcagtccgatgccgagtccgcgggcccgcatcaagccggttggctcgcgcgtctgcgcgccgagcgcggcaacttctgggcagcgttggactactgcttcaccacacctggcgaggcgtcggttgggttgcggatggtgagcgcgctgtggttctactgggctgctggcgactatctgagggagggccgcatgtggctggacagggcgttggccctggagaccgaacccaccagccagcgtgcccgcgcactgtggatcaccggatggattgcccaccggcaaggggaccgagatggggcgctggtcctgcttaacgaaagccgcgagctggcccggaaactgggcgacgaaacggaatttacctacgcgactcagtttcttggcgaccgggagatgtgggacaacaacctgactcgcgccacgcaactgctcgacgaggcactggcccgccaccgcgcaactggccactggaccggccccgccttagccattttctcaatacgagcgcaggcagcgggcctgcttggagaccttgaccgggcgatggtccttctgcacgaatgccgcaagatctgtacagaacttggcgagcgctggaggctatcgtgggcggagtggaacatggcgatcacttggtgggccgcgggcgacccaaccaaggcagccgcctccgcgtccaggtccctccgcaataagcgggaactcaacgacctactcgggatcagcgactgcgttgaactgctggcctgggtcgccgccgcagaacgcaatcctgaacgcgcggcgatccttttcggggcgttggataaaatgtgggaactgattggcaccccgctgttcggatccgagacgctactgacctggcgtgagcaggccaaggcacgcgcccaggaagcactcacagacaccgaatacgaaaccgcccgaggccaggggacgcggatgaaccgggagcagactatcttctatgctcttggggagaagccaccgccggtcgaagcggccgccgcttcggctccggaaaccgaaccggttctcacaaaacgagaacgcgaggtcgctgccctggtcaccgctggcaaaacaaacaaagagattgcggctgacctggtcatttcccagcgcacagccgaggcccacgtcgagaacatcctttccaagctgggctttacctcgcgcgcacaggtcatcagttggatgaccgggcagagataacgtagtcacctgctctgttggcccatgcccttctcgggccagcccggctcacatgatccgttcgcggcccggcaacaccgcccgtcgtggcaaggtctgcgataccgaaagcggacatccgcttcagctaatcgtccgcggcccccgcaacggcgcatgttgaagtaggtatggtccatgatcggaggctggccattgccgatggccatgaccgcggagttcgggtgctgcatgtagttgcggccgcccacataggacccgttggcgagcttacgcggtatagattgagccacgggccagcttcgtaggccttggctgttgccgccgacgagtagtgagtagccggtgtgaacggtctcccagcaccatcgagccaccgttcgtccggcttgtagtgcccgtgcgcgaagccttgcacacgtcgatagcgggctcttgagccaaaaactcgtcccgttccaacacgagcacatcgagtccgcgaccagcgagcgccccggcgacgatcagtcagcctccaccggacccgacgatcgccacgtctgccgatgcccggttgtccttgtgcatgatctgttgtgcctaactgcgcccagctttcgtcatcgagcctgtcccacagtctgccgatgcccggtccgagcagcctccagcgccgcccgtgcgaaggccaacgaccagaccccgtcttggccggaggccgggggctcggcctcgccacgcacagcctcgatgaaccgtcgaacacccacgacgtagaggtcctcgcgggtacccagatcgatcttcctggacccggccggaccgacgtgtgtcagcgtgccgaccggtgacatcgactggatacccgtgccgatgagcgctccttcggttccgaaaacctccaggcatgtgggggcatgtccggtcacgaagctttccacgaatgaagcatgcacaccgctgacgaactccgcgcttccggagattgtctcatcgattcccaccctcgtcatgtggccggacgaggtatgggccacgaccgttagcggatcggcattgagtacgaaccggagacagtccgcgtcgtgcaccgtgaggtcgagtgcgactccggcgcccgctgccgaatcggtcgtccgccatctccgcgcggcgggcggcagtcggatcgcgttccggacgttcactgcgaccggctcgccgatgtcgccggcggcgattgcatcccggatcaaacgatgtggcacggagttgcgcatgtggtggtttgtcgcgaacactacgcctgccttctccgcggcatcgacaagttcttgtgcctcggcgacggtcagggcaagcggtttttcgcacaggacgtgcttgccggctgcgatcgccgcaagtgcttgatcgtgatgtgccgagttgatactcgagatgtacacggcgtcgacgtcaggatcgctaagcgccacggtgagttcgtcatggccccgggcgccgaatggtgccgctacatcctgcgctcgggccaggtcgccgctgacgacgctgaccaccgcggcgtcaggctgggcggagatcgctgggcctacaaatgcgcgggcgatgtcgctggcgcccacgagcgaccagcggaagggacggttcgtcatgattcgatgggttcctttcgggaataccgcgcctgtgcgacatttccgctggcgcacagacgtgaggccagcgcgggtggccgcgaggattacacgaccatgaaacgggtcgccgcttgactgttagcaagatcggaggtttcgcataccccgcctgatctcgcttgcccacgagctgtcctggtagtgccaggtcgtcaggattttgtcagcgctccttccccacccggctgcacgtctcccgagccggccttccggatcgaacagcccgacatcgccgtcggctggctggatgccgtagcgtcggcgtagctgtttccagggagtacgccggtgtttgcgctcctgccaccggacgacctctttccagagatacgatcgtaggtagctgaaggtcgcgttcgggcatccatacctgaagtacgccttccaggcagcatccggttccggatagctttcaatgtggggaaaagctgggtcgccggcgacccgaaaaccgacggcaccgctcgcgcgcagcgtgcaccctggaggcgaggtccgtgctgctgatcgtgatcccgctggcgagtgggtagccctggatgaccgtagatcagcgcacgtaggtgatgagtttgggctcgggatcgctgacgtcagtgaccccgaggagcggacatggcttcgggttgcgctgatctggagacaggatgtttgtcggggttacacgttctggagcagtccgccatcgacacggacaacggatccggtgatgtagctggcacgctcgctggcgagaaatgtgaccgcgtcggcgaattcctcgcgccgcccgtagcggccgaccggaatagagctctctgattccctcgcgatgttctccgcagtgcggttctcccgtgcggcctttgcctggtccaactgggcgatgcgcgcagtggcgatgcgccccggaacgacgatgttgctggtgatgccgtcgcttgccacctcaccggacagtgtcttggaccagcccaccagactcgagcggagggcgttcgacaacccgaggttggggatgggcgcgatgacgccggacgaagtcgacgtgatgatccggccccatccccgctcggtcatgcccgggagcacgcggtctgtgatcgcgacgacggagaggatcatcgcctcgaagtgccgacgccacagggtggcgtcctgcccggacacacgggtgggcggcgggccgccggtgatgttgaccaggatctccaccgggccgagctcgctctcgacggcggtgacgttctcatcgatgaccgacaggttcgccaagtcccagaccaggctcatgttatcgccggtcatggacgcctcgacctccgtgagcgcgtccttgtcgatgtcggccagcgccacacgcgcgccttcccggcttagcgaggcggcaatggccgaaccgagtccgccgccggctccgagtacgagggcgactcttccattgattgcgagatccatgacatgtccttgcggtttcgggtgacggcggcccggaaagtcgtggcacgccgttgatggagggacattggtgggaggagtggcagtggcccggtcagccgcctaccacggcctgagcgctgacctcgaacaggacaccgggtcggagaccggcggtgatggtcgtccgggccgggccgggctcgctgaagtactcgcggtagatcgcgttcatcgcgtcgaagtcgtccccgtcagcgaggaacacattcacggtgatcacgtctgcctcgctgcagccggctgaacgcagcgcggtcatgaggttctcgaatgcccggcgcacctgaggttccagaccacccggtgcgagggatctgtcggcgaggtagccgcactgcccggcgattgccacgatgttgccgatgcgtacggcggcggagtaagggcctcccgcgggaggaaggtcgacgtctgtgaacgcctgacgggacacggtgtcggggcctctctgtggctggtggtcatgtccaactgacttcgggagcttgtggggtcggttcaaccggagcctcccgtaggaggtcctgagccccgtcagaagaacgtgaggacgccgtcgacgacgttgaagtcgtcgtcgatgatcgggatgaaggggagcttgtcgaaggccgtgcacgggtgggacatgtcgaaagcgacgatgtctccgggagcgatcgcgagcccgggggcaacgcgaacgaaggcgtgctggtccatcagcttgaacgtctccgcttcccgcagccgctgcctcgagccatccgcgcgaaacagctcgcgtggctgtggcagcgtcaggtcatgggccgcgtcgcgcttcccgatcgacaggatcgcgagatcaggctccggccgggacagcacggaagcccatgcagtgagtgcgttgtggagccggagcggttcctgctcggcccgtcggccagcgagcggcgagagcttttcgtacttgccggcgtcgtgggagatgtaacagccgcttcgaagcactaggtccacgtcgtcgcggacaccgtcccacgagccgagtccggcgacgacacgatcgaagtacgagcttccgcctgccgtcacgatgatgcggttggcgtcgaacaggtcgcgacgtgccagctcgagcacgatcgaccggacgccagcgaagaaggtgtcgagtgcatggaggtcctccggtgtcatgccgccggtcacgaggccctcgtaggcctcgacgccgaccagccggagatgctcggtcgcggcgaccgccgcggcgacctcgagcgccgagtcgaggtctcgcacgccacacctgccaccaggcactccgacctcgaggaggacgttgagggtgaccccgtggccggagtcggcgatggtatcggacatcgcccgcaccgtgtccgcatcgtcgaccaggcagtagaagtcgaacgagctgtcgctggcgatttcggcagtcacccaacgcagcgcgggagcatcgacgagttcgttggccaggatgatgcgctgaaccccgtagcggcgcatcacggccacctgagtgggcgtcgctgccgtgaacgcccacgcaccgtgagacgcctgaagggcgaagagctggggtgacatggtggtcttgccgtgcggggcgagaagcgcgttgttgcgctcgcagtacgcctccatagtcgccaggttggcgttcatagcgcgtgcgtggagtgtggtcaccggcagggcgaggtctccgcgggccacgttccagttctgctggtccacctctccgaggagcacacgagcacccaggggcacgcccttgagtgcgtcgtcgaggacggtctcgcggaggtcgtcggcacattgcaggagtcgggtccggtcgagctgctcgaccgcgtgagtgctcatcgtgtagtggcctttcgcgccgtcgtggtcagctgaccgatgccgtcgatccggcactccacacggtctccgtcgccgatgacgagcgcgccaggggttccggtggagatgatgtctcccggaaacagcggcatcatcttcgagtggaagctcacgaggctggcgggcttgtgggtcatgtgggcgaccgtgttggtcctgaactcatcgccgttcttgaccgtcgagatctcgatgtcgtccaagctttcgaacttctctatcacctcatcgagcggtacgagctccggtccgaagcagaagaacgtccggaagttcttcgagcgggtgagatagcgcggattgatccgcaagatgtcctcggcggtctggtccaggatggtcgtgaccccccacacgtagtccatcgcctcggactcgctgacgttctcgcaagtcctgccgatgatgagcccgatctcagcctcggacgtggtgcgctcactctgcgccggaatcacgatcggctcatccgggccgatgatcgtgtggtcgcacttcacgaaggacgccggctggtcgggcgccgactcgctcaggtccgctgcgtgatcgccgtagttcagaccgatgccccagatcttccggggggatcggtacggcgcggtgaaccgcacctcgtccacgcgtgtgaaggcgaggtcgggggcgttcttgacacgctcacgcagccgcgcgaggtggtctcctgcgatcacgtccatgatggtcgtgaccgccagctcggggtctatctcccggattgctgcgacgccgcggtcgctcacgacaacggggatctctccttccgcagcggtgatggtcgccaggtgctcggtcacgaaagcccgtccttcggtcgaatggtgaggtagggggtgggggagttggtttaactcgttcccgggggcacgttcccgcgctgcgtgtgtgaggagaggacaagcgacatcacgtggaggatgtggtcggcgttgttccgggctgcccggtcggcgtcgccagccagaacggcggatgccgtcgcgatgtgctccgaggcgcaggagatggagtcaccggtcgagggagtgtcgcgttctcggagtacagcggtcagcaccagggcgttgtcgaccgcgcgctggaggatctcgttcccgcagaactcggcgatgatgtggtggaagacgcgatcctcggcgcggaactgggcggagtcgccggactctgccgcgcgcagggatgaggtggcgacctcgtggagcctctcccgttgggcgctggtagcccgatgtgcggtgaaccaggctgccgagctctccagccccgcccggtgctcgtaggcgtcgcgaatggcgcggaccgaggcgctgatgacgcgcagccccttcggggcagcctcgaccaggcccacgtgccgcaagcggagaagcgcctcgcgcacgggggtcttgctgacattcagctcggccgcgagcttggcctcgctcacacgacgcccaggtgggagtgcctgacttacgatgctgtcgcggatggcctcgaagacccgatctgtcagattgtcgacgcgtgcgtcgaggggtgcgagcataccgttgccggaccccaccgcggagtctgcggcggctgggcgatggtgcagctccaccatgttcagcgtgcccgcagtgcgtggctgattcggttccatcgtcccccttccttggacagtggaatacggtatatggtcctcaccgcgtaagcaaccgcccgaggcgggactccgtagcggatgaagtccttgggatatgtcgtataccgagggagagctgatgaagcccgagtcgcacccggccttcgagagcctggatcgactggccacgatcgagatgcgtccgccgacgagcccggccggcatcgtgagcccgttctacacgctggcgcggggtgagcggtcggagccgatcagccttgcgatcgcgcgctctctgctgcgtcgacagggtgaaaaggcgttgatcgtcacgggtctggtcgaggaaggccggttcccgcagggggaggtggacggccccatcggctctctggcactcgcgcgcacgctcgccggtcttggtagcgaggtgaccatcgtcatcgacccagaggccgtcggcccggtggagaagctggtcgacgctgcgggcctggatggcgtgaccttgatggagtcccgattctccagcgcggccgaggcccgggagttcgcggcgcagttcggcgtcgtcgccgccatcgagaagctggggcagaactctgttggcggccgtcatctgatctggggcacgccggtcaccgccggtgatctgtttgccgacgactaccttcgcgccgccacggacaacggtgctctgacgctggccgtgggagacaacggcaacgagatcgggttcggcaacattgccgccgagtccgaggcgctgactccgcgaggcgtcagcgttgagggcggattcttcgcgtccacgacggtggatcatctgctgcctgcatccgtgtcgaatttgggctgctacgtcatcaccggtgcggtggccatcctggctcgacgcgcaaacctggcagtcaccggggatctggtgcgcgagtggaccgagctggggctgcgcgcaggtctacgcagcggcggcgttgacgatcccgcgttccaaggcgacgacgggatcccactgcgtttcgtcgccgcgcatgccgagctgatctccggaatcgttcaccagagcctgctcggcgacccctgggtggcagaccagtgacggccacccgtagcgggcaaccctcggttgccagccttcgtcatcatcgccgggaaggggaagtcatcgatggagttcgttgatctgcagcacgcggagcccatcgaggcatggcgtgccaaccgcgcgaatgcgtgggcgaggcccacgtccgggatctgtcatggattcgtgcaggccaacctcgtgatgctgccccaggatgacgcgttcgacttcatgcggttcgcccagcggaaccccaagccgtgcccgatcctcgaggtcaccgacgcgggagatccggagccgaagctgaccgcccctggtgctgacctccgcaccgacctgcccaaatacagcgtgtaccgggaaggggcgctggtggaggagcgcagtgacgtcgttgacctgtggaccgacgacatggtcgcgttcctgcttggctgcagcttctccttcgagcacttgctgctcgatgccggactcccgatccggcacatcgaccaggggatcaacggcccggtttacctcagcaaccgtgagtgtgtgcccgcaggccagttccgggggaagctagtggtttcaatgcgtcccatgcccccggaccgggtggcggaggctgtcaccatcacgcatgcgcatcccgaggtgcacgggggccccgtgcacatcggctcccctgagaagttgggcatcgacaacgttgatgaacctgactggggtgaacgagtgcgtatggagccgggcgacgtgccggtgttctgggcctgcggcgtgaccccgcagcaggcggcgatcgaggcgaagaccgagctaatgatcacgcactcgacgggtcacatgttcgtgaccggaatgcggatcgactccgagtgaggcgggggccccggggtggtgcc

SEQ ID NO: 5 - DNA, 50000 bp, Saccharopolyspora spinosa
gggcgcgccgcaattcgatgacgttcatgcgccgtgtcggggaatcgccggtggcggcgccagcagaggctgaacttactggtggtgtgtccaggaatcggaggggcagtaccgaatgagcgaagccgggaacctgatagccgtcatcggactgtcctgccgcctaccccaggcgcctgacccggcttccttctggcggttgctgcgcaccggaacggacgccatcaccacggtcccggaagggcggtggggcgacccgttgcctggtcgggatgcgcccaagggcccggaatggggtggtttcctggctgatgtcgactgcttcgatcccgagttcttcgggatctcgccgcgagaagcggcagccgtggatccccagcagaggctggctctggagctcgcctgggaggcactcgaagacgccggtatccccgccggcgagctgcgcggtactgccgccggtgtgttcatgggggcgatctctgacgactacgccgccctgctgcgcgagagcccgccggaagtggctgcgcagtaccgcctcaccggcacccatcgaagcctgatcgccaaccgcgtgtcctatgtgctcggcctgcgcgggccaagcctgacggtggattcaggtcagtcctcgtccctggtcggcgtgcatctcgccagcgagagcctgcgacggggtgagtgcacgatcgcactcgccggcggcgtgaacctcaacctggccgccgagagcaacagcgctctgatggacttcggcgcgctctccccggacggtcgctgcttcaccttcgatgtgcgggcgaacggttacgtccgtggtgagggcggcggccttgtcgtgctgaagaaggccgatcaggcgcacgccgatggcgaccggatctactgcctcatccgcggcagcgcggtcaacaacgatgggggcggtgccgggctcaccgttccggcggcggacgcccaggcggagctgctgcgccaggcataccggaacgcgggcgtcgacccggccgccgtgcagtatgtcgagctccacggcagcgcgaccagggtcggggatcccgtcgaagcagcagccctcggagctgtcctgggggcggcgagacggcccggcgacgagctgcgtgtggggtcggcgaagaccaacgtcggccatctggaagcagcggcgggcgtcaccgggttgctgaagaccgcactcagcatctggcaccgcgaactgccgccgagtcttcatttcaccgcccccaacccggaaatcccgctggacgaattgaacctacgcgtccagcgtgatctgcggccgtggccggagagcgaggggccgctgctggccggcgtcagcgccttcggaatgggaggcacgaactgccacctggtgctctccggcacgtcccgggtggagcgacggcgcagtggacccgctgaggcgaccatgccgtgggtcttgtcggccagaacaccggtcgcattgcgtgcgcaggcggcgcgcttgcacacgcacctcaatacggccggtcaaagtccgttggacgtcgcctactcactggcgaccactcgatccgcgctgccgcaccgggccgcgctggtcgcggacgacgaaccgaaactgctcgccgggttgaaggccctcgctgacggcgacgacgcgcccacgctgtgccacggcgcgacttccggcgagcgggcagcggtcttcgtctttcccggacagggcagccagtggatcgggatgggtaggcagctgctcgaaacctccgaggttttcgcggcgtcgatgtcggactgcgccgacgcattggcgccgcacctggattggtccctgctggatgtgctgcgcaacgcggccggcgctgcgcaccttgaccacgacgatgtcgtccagcccgcgctgttcgccatcatggtctcgctcgcggagctctggcgttcgtggggcgtgcgtccggtggcggtcgtcgggcactcgcagggggagatcgcggcggcctgcgtcgccggggccctgtccgtccgcgatgccgccagggtggtggcggtgcgcagcaggcttctgacggcgctggccggcagtggcgcgatggcctcgttgcagcatcccgccgaagaggtgcggcaaatcctgttgccctggcgcgatcggatcggcgtggcgggggtgaacggaccgtcgtcgaccctggtgtcaggggaccgggaggcgatggcggaactgctggccgagtgcgcagaccgagagctccggatgcgccggattcccgttgaatacgcctcccattcgcctcacatcgaggttgtccgggatgagctgctggggctgttggcgccggtcgaacccaggacgggaagcatcccgatctattcgacgacgaccggggacctgctggaccggccgatggacgccgactactggtaccgcaaccttcgtcaaccggtgctgttcgaagcggccgtcgaggccctgttgaagcgggggtacgacgcattcatcgagatcagcccacacccggtgctgactgcgaacatccaggaaaccgccgtgcgagcagggcgggaggtagtggcgctcgggacactccgccgcggcgaaggtggcatgcggcaggcgctgacgtcgctggccagagcacacgtacacggagtggccgcggactggcacgcggtcttcgccggtaccggggcgcagcgggtcgacctgccgacgtacgcctttcagcgacagcgctactggctggacgcgaagcttcccgacgtcgccatgcccgagagcgacgtgtcgacggcgttgcgggaaaagctgcggtcttcgccgagggcggacgtggactcgacgaccctcacgatgatccgggcacaggcagccgtggtcctcggccactccgatccgaaagaggtggacccggatcggacgttcaaggacctgggcttcgattcctcgatggtggtcgagctgtgcgaccgcctaaacgccgccacaggtctgcgactcgcaccgagcgtcgttttcgactgtcctacgccggacaagctcgcccgccaggtacggacgttgttgttgggcgagccggctcccatgacgtcacaccggccggactccgatgcggacgagcctatcgccgtgatcgggatgggctgtcggtttccgggtggggtgtcctcgcccgaggagttgtggcagttggtcgccgctgggcgggacgtcgtgtccgagttcccggctgaccgaggttgggacctggagcgtgcggggacatcgcacgtgcgcgccggcgggttcttgcatggcgccccggattttgaccccgggttcttccggatttcgccgcgcgaggcgttggcgatggatccacagcagcggttgctgctggaaatcgcctgggaagcagtcgaacgaggcgggatcaacccgcagcacctgcacggaagtcaaaccggggtcttcgtcggcgcgacctccctggactacgggccacgcctgcacgaagcgtccgaggaggcggccgggtacgtgctcaccggcagcaccacgagtgtggcgtcgggtcgggttgcgtattcgttcgggttcgagggccctgcggtgacggtggatacggcgtgttcgtcgtcgttggtggccctgcatttggcgtgtcagtcgttgcgttcgggtgagtgtgatctggcgttggccggtggtgtgaccgtgatggccacgccggggatgttcgtggagttttcgcggcagcgtggtttggcgccggatgggcggtgcaagtcgttcgcggaggccgccgacggcaccggctggtccgagggtgctggcctggttctactggagcggttgtcggatgcccggcggaatgggcatgaggtgctggcggttgttcgtggtagtgcggtgaatcaggacggtgcgtcgaatggtttgaccgcgccgaatggttcgtcgcagcagcgggtgattgcccaggcattggcgagtgcggggttgtcggtgtccgatgtggatgctgtggaggcgcatgggacgggcacgcggcttggtgatccgatcgaggcgcaggcgctgatcgccacctacggccagggccggcttccggaacggccattgtggttgggctcgatgaagtcgaacatcggtcacgcgcaggcagctgcggggatagccggcgtcatgaagatggtgatggcgatgcggcacgggcagctaccgcgcacgttgcacgtggatgagccgacttctggggtggattggtcggcggggacggttcaactccttacggagaacacgccctggcccgggagtggtcgtgttcgtcgggtgggggtgtcgtcgttcgggatcagtggtactaacgcgcacgtcatcctcgaacagcccccgggagtgccgagtcagtctgcggggccgggttcgggctctgtcgtggatgttccggtggtgccgtggatggtgtcgggcaaaacacccgaagcgctatccgcgcaggcaacggcgttgatgacctatctggacgagcgacctgatgtctcctcgctggatgttgggtactcgctggcgttgacacggtcggcgctggatgagcgagcggtggtgctggggtcggaccgtgaaacgttgttgtgcggtgtgaaagcgctgtctgccggtcatgaggcttctgggttggtgaccggatctgtgggggctgggggccgcatcgggtttgtgttttccggtcagggtggtcagtggctggggatgggccgggggctttaccgggcttttccggtgttcgctgctgcctttgacgaagcttgtgccgagctggatgcgcatctgggccaggaaatcggggttcgggaggtggtgtccggttcggatgcgcagttgctggatcggacgttgtgggcgcagtcgggtttgttcgcgttgcaggtgggcttgctgaagttgctggattcgtggggggttcggccgagtgtggtgttggggcattcggtgggcgagttggcggcggcgttcgcggcgggtgtggtgtcgttgtcgggtgcggctcggttggtggcgggtcgtgcccggttgatgcaggcgttgccgtctggcggtgggatgctggcggtgcctgctggtgaggagctgttgtggtcgttgttggccgatcagggtgatcgtgtggggatcgccgcggtcaacgctgcggggtcggtggtgctctctggtgatcgggatgtgctcgatgaccttgccggtcggctggacgggcaagggatccggtcgaggtggttgcgggtgtcgcatgcgtttcattcgtatcggatggatccgatgctggcggagttcgccgaattggcacgaaccgtggattaccggcgttgtgaagtgccgatcgtgtcgaccttgaccggagacctcgatgacgctggcaggatgagcgggcccgactactgggtgcgtcaggtgcgagagccggtccgcttcgccgacggtgtccaggcgctggtcgagcacgatgtggccaccgttgtcgagctcggtccggacggggcgttgtcggcgctgatccaggaatgtgtcgccgcatccgatcacgccgggcggctgagcgcggtcccggcgatgcgcaggaaccaggacgaggcgcagaaggtgatgacggccctggcacacgtccacgtacgtggtggtgcggtggactggcggtcgttcttcgccggtacaagggcgaagcaaatcgagctgcccacctacgccttccaacgacagcggtactggctgaacgcgctgcgtgaatcttccgccggcgacatgggcaggcgtgtcgaagcgaagttctggggcgccgtcgagcacgaagatgtggaatcgcttgcacgcgtattgggcattgtggacgacggcgctgctgtggattccctgagaagcgcccttccggtgttggccggttggcagcgaacccgcaccaccgagtccattatggatcagcggtgttaccgaattggctggcggcaggtagccggactcccgccgatgggaactgttttcggtacctggctggtcttcgcgcctcatggctggtccagcgaaccggaggtggtggactgcgttacggcactgcgggcacgtggtgcctcggtggtgttggtggaagctgatcccgacccgacctccttcggcgaccgggtacgaaccctgtgttcgggccttccggatcttgttggcgtgttgtcaatgttgtgcttggaagaatcggtccttccgggattttctgcggtgtcacggggttttgcgttgaccgtggagttggtgcgggttttgcgggcagctggtgcgactgcccggttgtggttgctgacgtgtggtggcgtgtcggtgggagatgtaccggttcgtccagcgcaggccctggcgtgggggttggggcgtgttgtggggttggagcatccggactggtggggcggcttgatcgatattccggtcttgttcgacgaagacgctcaagagcggttgtcgattgtgctggcaggtctcgatgaggacgaggtcgcgatccgtcctgacggcatgttcgcgcgtcggttggtacgccacactgtctcagctgatgtgaagaaggcgtggcgccccaggggatcggtgctggtgacgggcggcacgggtggtttgggggcgcacgttgctcgctggctggccgacgccggagccgaacatgtggcgatggtgagtcgacgcggcgagcaggcaccgagtgctgagaagttgcggacggaactggaggatctgggtacccgggtgtcgatcgtgtcatgcgatgtgaccgatcgcgaggcgctcgccgaagtgctgaaagcccttccggctgaaaacccgttgaccgcggtagtgcatgcggcaggcgtgatcgagactggtgatgcggcggcaatgagcctggctgatttcgatcacgtgttgtccgcaaaggtggccggtgccgcgaatctggatgccttgttggccgatgtggaattggacgcgttcgtcttgttctcatcggtgtcaggagtttggggcgctgggggacacggggcttacgcagcggcgaatgcctatctggatgcgctcgcggaacagcgtcggtcgcgagggctggtcgcgactgcggtggcctgggggccgtgggccggcgagggcatggcctccggagaaacaggagaccagctgcgccgatacggcctttccccaatggctccgcagcacgccatcgccggaatccggcaggccgtggaacaggacgaaatttccctggtagtggccgatgtcgattgggcacgtttcagcgcgggattgctggcggctaggccgcggccgctgctgaacgaactggccgaggtcaaggaactcctcgtcgatgcccagcccgaggcgggagtccttgccgacgcgtcgttggaatggcggcagcgattgtccgcggcaccgaggccgacacaggaacagctgatcctggagctggtacgcggcgaaaccgctctggtgctgggacaccccggggcagcggccgttgcatcggaacgagccttcaaggacagcggattcgactcgcaggccgcggtcgaactccgcgttcggctcaatcgagctaccggcctccagttgccatcgacaattatcttcagccatcccacgcctgcggaactggctgcggagctgcgggcgaggcttcttcccgagtccgcaggagcaggcattcccgaggaggacgaggcgcgaatcagagcggcactgacgtcgatcccgttcccggccttgcgcgaggcaggcttggtgagtccgctgctcgcacttgccggacacccggtcgactccggtatctcctcggacgatgcggccgcgacctcgatcgatgcgatggatgtagccggcctcgtcgaagcagcgctgggcgaacgcgagtcctgagaccgccgacctgggagatgacggtgaccaccagttacgaagaagttgtcgaggcactgcgagcatcgctcaaggagaacgaacgcctccggcgcggcagggatcggttctccgcggagaaggacgatcccatcgcgatcgtggcgatgagttgtcgttatcccggtcaggtctcctcgccggaggacctgtggcaactggctgccggcggtgtggacgcgatctccgaagttccgggggatcgcggatgggacctggatggcgtgttcgttccggactccgatcgtcctggcacgtcgtatgcctgcgcgggcggttttcttcagggcgtgtcggagttcgacgcgggtttcttcgggatttcgccgcgtgaggcgctggcgatggatccgcagcagcggttgctgctggaagtcgcgtgggaggtcttcgagcgggctgggctggagcagcggtcgacacgcggttcccgcgttggcgtgttcgtcggcaccaatggccaggactacgcgtcgtggttgcggacgccgccgcctgcggtggcaggtcatgtgctgacgggcggtgcggcagcggttctttcgggccgggttgcgtattcgttcgggttcgagggtcctgcggtgacggtggatacggcgtgttcgtcgtcgttggtggcgttgcacctggcggggcaagcactgcgggccggtgagtgcgaccttgcccttgccggtggcgtcacggtgatgtcgacgccgaaggtgttcctggagttctcccgccaacggggtctcgcgccggatgggcggtgcaagtcgttcgcggcgggtgcggatggcactggatggggtgagggtgccggactgttgttgctggagcggttgtcggatgcccggcggaatgggcatgaggtgctggcggttgttcgtggtagtgcggtgaatcaggacggtgcgtcgaatggtttgaccgcgccgaatggttcgtcgcagcagcgggtgattacccaggcgttggcgagtgcggggttgtcggtgtccgatgtggatgctgtggaggcgcatgggacgggcacgcggcttggtgatccgatcgaggcgcaggcgctgatcgccacctacggccgtgatcgtgatcctggccggccgttgtggttggggtcggtcaagtcgaacatcggtcatacgcaagcggcggcgggtgtggctggtgtgatcaagatggtgatggcgatgcggcacgggcagctgccacgcacgttgcacgtggaatcgccgtcgccggaggtggattggtcggcggggacggttcaactccttacggagaacacgccctggcccaggagtggtcgtgttcgtcgggtgggggtgtcgtcgttcgggatcagtggtactaacgcgcacgtcatcctcgaacagcccccgggagtgccgagtcagtctgcggggccgggttcgggttctgtcgtggatgttccggtggtgccgtggatggtgtcgggcaaaacacccgaagcgctatccgcgcaggcaacggcgttgatgacctatctggacgagcgacctgatgtctcctcgctggatgttgggtactcgctggcgttgacacggtcggcgctggatgagcgagcggtggtgctggggtcggaccgtgaaacgttgttgtgcggtgtgaaagcgctgtctgccggtcatgaggcttctgggttggtgaccggatctgtgggggctgggggccgcatcgggtttgtgttttccggtcagggtggtcagtggctggggatgggccgggggctttaccgggcttttccggtgttcgctgctgcctttgacgaagcttgtgccgagctggatgcacatctgggccaggaaatcggggttcgggaggtggtgtccggttcggatgcgcagttgctggatcggacgttgtgggcgcagtcgggtttgttcgcgttgcaggtgggcttgctgaagttgctggattcgtggggggttcggccgagtgtggtgttggggcattcggtgggcgagttggcggcggcgttcgcggcgggtgtggtgtcgttgtcgggtgcggctcggttggtggcgggtcgtgcccggttgatgcaggcgttgccgtctggcggtgggatgctggcggtgcctgctggtgaggagctgttgtggtcgttgttggccgatcagggtgatcgtgtggggatcgccgcggtcaacgctgcggggtcggtggtgctctctggtgatcgggatgtgctcgatgaccttgccggtcggctggacgggcaagggatccggtcgaggtggttgcgggtgtcgcatgcgtttcattcgtatcggatggatccgatgctggcggagttcgccgaattggcacgaaccgtggattaccggcgttgtgaagtgccgatcgtgtcgaccttgaccggagacctcgatgacgctggcaggatgagcgggcccgactactgggtgcgtcaggtgcgagagccggtccgcttcgccgacggtgtccaggcgctggtcgagcacgatgtggccactgttgtcgagctcggtccggacggggcgttgtcggcgctgatccaggaatgtgtcgccgcatccgatcacgccgggcggctgagcgcggtcccggcgatgcgcaggaaccaggacgaggcgcagaaggtgatgacggccctggcacacgtccacgtacgtggtggtgcggtggactggcggtcgttcttcgccggtacgggagcgaaacaaatcgagctgcccacctacgccttccaacgacagcggtactggctggtgccatcggattccggtgatgtgacaggtgccggtctggccggggcggagcatccgctgttgggtgctgtggtgccggtcgcgggtggtgacgaggtgttgctgaccggcaggatttcggtgcggacgcatccgtggctggccgaacaccgggtgctgggtgaagtgatcgttgcgggcaccgcgttgctggagatcgccttgcacgcgggggaacgtcttggttgtgaacgggtggaagagctcaccctggaagcaccgctggtcctgccggagcgcggggcgatccaggttcagctgcgagtgggcgcgcccgagaattccggacgcaggccgatggcgctgtattcacgccccgaaggggcggcggagcatgactggacgcggcacgccacgggccggttggcgccaggccgcggcgaggcggctggagacctggccgactggccggctcctggcgcgctgccggtcgacctcgacgaattctatcgggacctcgcagagcttgggctggagtacggcccgatcttccaagggctcaaggcggcctggcggcaaggggacgaggtgtacgccgaagccgcgctgccgggaacggaagattctggtttcggggtgcatccggcactgctggacgcggctctgcacgcaacggctgtccgagacatggatgacgcacgcttgccgttccagtgggaaggtgtgtccctgcacgccaaggccgcgccggctttgcgggtccgcgtggtcccggctggtgacgatgccaagtccctgctggtttgtgatggcaccggtcgaccggtgatctcggtggaccgactcgtattgcggtcggctgcggcccggcggaccggtgcgcgccgacaggcccatcaagctcggttgtaccggttgagctggccaacggttcaactgccgacatccgctcagccaccgtcctgcgtgcttctcggcacctcagaagtgtccgctgacatacaggtgtatccggacctccggtcgttgacggctgcgttggatgccggtgccgaaccacccggcgtcgtcatcgcacccacgccccccggcggtggacgaacagcggatgtccgggagacgactcggcatgcactcgacctggtacaaggctggctttccgatcagcgactcaacgaatcccgattgctcctggtgacacagggagcagtggccgtggagccgggcgaacccgtgaccgatctggcgcaggccgcgctctggggactgctgcggtcgacgcagaccgaacaccctgatcgcttcgtcctcgtcgatgtgcctgagcccgcgcaactcctccccgcgctgccgggggtgctggcctgcggcgaacctcagctcgcgttgcgacgtggcggcgctcatgcgcccagactggctggactgggcagcgatgacgtcctgcccgtgccggacggcaccgggtggcgattggaggccacgcgcccgggaagcctggatgggttggcattggtggacgaaccgacggccacggcaccgctgggtgacggtgaggtcaggattgcgatgcgcgcggccggggtgaacttccgggatgcgctcatcgcgctcggtatgtatcccggtgtggcatcgctgggcagtgagggcgccggggtcgtggtggagaccggccccggcgtcaccggcctggcacccggcgaccgcgtgatgggaatgatcccgaaggcgttcgggccgctcgcggtcgccgaccatcgcatggtgacgaggattcccgctggttggagcttcgcgcgggccgcatcggtgccgatcgtctttctcaccgcctactacgcgctggttgatctcgccgggttgagaccaggggagtcgttgctggttcattcggccgccggtggggtggggatggccgcgatccaactcgccaggcacctcggtgcagaggtgtacgccaccgctagcgaggacaagtggcaagccgtggagctgagccgagaacacctcgcttcgtcgcggacgtgcgatttcgagcagcagttcctcggggcaaccggcggacgcggcgtcgacgtcgtgctcaactccctcgccggggagttcgccgatgcgtctctgcgaatgctgccgcgcggtggccgtttcctggagttggggaagacggatgttcgtgaccccgtcgaggtcgccgatgcgcatccgggcgtgtcttaccaggctttcgataccgtagaggcaggcccgcagcgaatcggcgagatgcttcacgagctggtggagttgttcgagggacgcgtgctggagcccctgcctgtcacggcttgggacgttcggcaggcgcccgaggcgctacggcacctgagccaagcgcggcatgtgggaaagctggtgctcaccatgcctccggtgtgggacgccgcaggcacggttctggttaccggcggaacgggagcacttggcgcagaggtcgcccggcacctcgtgatcgagcgcggggtgcgaaacctggtcctcgtcagcaggcgcggtcccgcagccagtggcgctgctgagctcgtggcgcaactgacggcctacggtgccgaggtttccttgcaggcttgcgatgtcgccgatcgtgagaccttggcgaaggtgcttgccagcatcccggacgagcatccgttgaccgccgtggtgcacgcggctggtgttctcgacgacggagtgtccgaatcgctcaccgtggagcggctggaccaggttctgcgcccgaaggtcgatggcgcgcggaatctgctcgagctgatcgacccggacgtggccctcgtgttgttctcgtcggtgtcgggtgtgctcggcagcggtgggcagggtaactacgcggcggccaactccttcctcgacgcattggcgcagcaaaggcagtcgcgcggcctaccgacgagatcattggcctgggggccctgggcggaacatggcatggccagcaccttgcgcgaagccgagcaggatcgattggcgcgatctgggttgctgccgatctcgaccgaggaggggttgtcccagttcgacgccgcgtgcggcggcgcgcataccgtggtggcgccggttcgattcagccgcttgtccgacgggaacgcgatcaagttctccgtcctgcaaggtttggtcgggccgcatcgcgtcaacaaagcggcgactgcggatgatgccgagagcctccggaaacggttgggacgcttgccggatgcagaacaacatcggattctgctggacctcgtccgcatgcatgtggcggcagtgctcggattcgccggttctcaggagatcaccgcggacggcacgttcaaggtgctgggcttcgactcgttgaccgtggtcgagttgcgcaaccggatcaacggggcgacggggctgcgactgcccgccaccctggtgttcaactacccgacgccggatgcgctcgccgcgcacctcgtcaccgcgctgtccgcagaccgcctggccgggacattcgaggaactcgacaggtgggcggcgaacctgcccacgctggccagggatgaggccacgcgggcgcagatcaccacccggctacaggcgatcttgcagagcctggcggacgtgtccggcggaaccggcggcggctccgtgccggaccggctcagatcggccacggacgacgagcttttccaactcctcgacaacgatctcgaacttccctgatgcctcagccggagccttcgcaacttcctggagggaaacgccacatgtcgaatgaagagaagctccgggagtacttgcggcgtgcgctcgtggatctgcaccaggcgcgcgagcggctgcacgaggcggagtcgggagagcgggaacccatcgcgatcgtggcgatgggctgccggtacccgggtggggtgcaggacccggaagggctgtggaaactggtcgcctccggtggcgacgccatcggtgaattccccgctgatcgtggttggcacctcgacgagctctacgatcccgacccggatcagcccggaacctgctacacccggcacggcggcttcctccacgacgccggcgagttcgacgcgggattcttcgacatcagcccccgtgaggcgctcgcgatggacccgcagcagcggctgctgctggaaatctcctgggagaccgtcgaatccgctgggatggacccgaggtccttgcgggggagccgcaccggggtgttcgcgggattgatgtacgagggctatgacaccggcgcccaccgggcaggagaaggtgtcgaaggctatctcggaaccggcaatgcgggaagcgtcgcctctggtcgggttgcgtatgcgttcgggttcgagggcccagcggtgacggtagacacggcgtgctcgtcgtcgttggtggcgctgcatttggcgtgtcagtcgttgcggcagggcgagtgtgatctggcgctggccggtggagtgacggtgatgtcgacgccggagaggttcgtggagttctcccgtcagcgtggtctcgcaccggatgggcggtgtaagtcgttcgcggcggctgcggatggaaccggttggggtgagggtgccggtttggtgttgctggagcggctgtcagacgccaggcggaacgggcatcgggtactggcggttgttcgtggtagcgcggtgaatcaggacggtgcgtcgaacggattgacggccccgaacgggctggcccaggagcgggtcattcagcaggtgctcacgagtgcggggctgtcggcgtccgatgtggacgctgtggaggcgcatggaacgggtacgcggcttggtgatccgatcgaggcgcaggctctgatagccgcctatggacaggatcgggaccgggaccggccgctgtggttggggtcggtcaagtccaacatcggtcatacgcaggcggctgcgggcgtcgctggtgtgatcaagatggtcatggcgatgcggcacggggagctgccgcgcacgttgcacgtggacgagccgaattcgcacgtggactggtcggctggtgcggtccgactcctgaccgagaacatccgctggccagggacgggtacgcgccgcgctggagtgtcgtcgttcggggtaagcggtaccaacgcacacgtcatcctcgaacacgacccgctcgccgtgaccgagaacgaggaagcagcgcagtccccagcacctgggatcgtgccctgggcgttgtccgggcggtcgtcgacggcgctgcgggcccaggccgaacggctgcgcgagctgtgcgagcagaccgatcccgaccccgtcgatgtcggtttctcactggccgccacgcgcacggcttgggagcaccgagcggtggtgcttggtcgggacagcgctacgttgcgctccgggcttggcgttgttgccagcggtgaaccagcggtcgatgtcgttgaggggagcgtcctggacggcgaggtcgtcttcgtcttccccggtcagggctggcagtgggccggtatggcagtcgacctgctggacgcttcgccgacgttcgcgcgccacatggacgagtgcgccaccgcgctgcggaggtacgtggactggtcgttggtcgacgtgctgcgcggagcggagaactccccaccgctggaccgggtggacgtgctccagcccgcgtccttcgcggtgatggtgtcgctcgccgaggtgtggcgttcctacggggtgaggccggcggccgtcgtcggccacagtcaaggcgaaatcgccgcggcctgcgcagccggggtgctgccgctggaggatgcggccaggcttgtcgcattgcgcagcagagcgttgaagggactttcggggcggggtggcatggcgtcgctggcctgccctgcggatgaggtcgcggcattgttcgcgggatcgggcggccgtctggaagttgcggcgatcaacggcccgcgatcggtcgtggtgtccggcgatctggaagcggtggacgaactgctggcagagtgcgctgaaaaggacatgcgtgcacgccgtatccccgtcgactacgcctcgcattcagcgcacgtggaggtggttcggagcccggtgctggcggccgccgccggggtgcgacaccgggacggccaggtgccgtggtggtcgacggtgatcggcgactgggtggatccggccaggctggacggcgagtattggtatcggaacctccggcagccggtccggttcgaacacgccgtgcagggcctggtcgagcggggattcggcctgttcatcgaaatgagtgcgcatccggtgctgaccacggcggtcgaggaaaccggtgcggagtcggagaccgccgtggccgcggtaggtaccttgcgacgtgactcgggcggcctccggaggttgttgcattcgctggccgaggcgtacgtgcgcggcgccaccgtggactgggccgtggcgttcgggggcgcgggccgacggctggacctgccgacctacccgttccagcgccagcggtactggctggacaagggagctgcctccgacgaggctcgtgcggtctcggacccggcggcgggctggttctggcaagccgtggcgcgccaagacctgaaaagcgtgtccgatgccctcgatctcgacgccgacgcaccgctgagcgcaacacttccagccctgtccgtctggcaccgtcaggaacgagaaagggtcttggcagacggttggcggtaccgagtcgactgggtacgggtggccccgcagccggtccggagaacgcgggaaacctggctcctggtcgttcccccgggcggcatcgaggaagcgctggtcgaacggctgacggatgcgttgaacacgcgagggatcagcaccctgcgcctcgacgtgccaccggcggcgaccagtggcgaactcgcaaccgaactccgcgccgcagccgacggtgacccggtgaaggcaatcctgtcgctcaccgcgttggacgagcgaccccaccccgaatgcaaggacgtcccgagcgggattgccttgctgctgaacctggtcaaggcgctcggtgaagccgacctcagaattcctctgtggaccatcacgcgtggtgcggtcaaggcaggccccgcagatcggctgctgcgcccgatgcaggcgcaagcatggggtctggggcgagtagccgcactcgaacaccccgagcgctggggtgggctgatcgacctgccggattcgctggacggcgacgtcctcacgaggctgggcgaagcgctcaccaacggcttggcggaagaccaactggcgattcgccagtcgggcgtgctggcccggcgactggtacccgccccggcgaatcagcccgctggacgtaagtggcgcccccgagggagcgcgctgatcacgggcggactcggcgcggtgggcgcacaggtggcgaggtggttggccgaaatcggagccgagcgaatcgtgctcaccagtcgacggggcaaccaagcagcaggcgccgccgagctggaagccgaactccgggcccttggagcgcaagtgtccatcgtggcttgcgacgtgaccgatcgtgccgagatgtccgcactactggccgagttcgacgtcaccgcggtgttccacgcggccggagtcggtcggctgctgccgttggcggagaccgaccagaacggcctggccgaaatatgcgcggcgaaggtccgcggcgctcaggtgctggacgaactgtgcgacagcaccgatctcgatgccttcgtcctgttctcctcgggtgccggggtatggggcgggggcggtcagggcgcttacggcgcggcgaacgcattcttggacacactcgccgaacaacgccgagcacgcggtctgccggcaacctcgatctcctggggcagttgggccggcggcggcatggccgacggcgcggcgggcgaacacctgcggcgacgcgggatacgtccgatgccggcggcgtcggccatcctggctctgcaggaagtacttgaccaggatgagacgtgcgtgtcgatcgctgatgtggactgggaccgattcgttcccacgttcgccgcgactcgcgccacccggttgttcgacgaagtgccggcggcgagaaaggcgatgcccgcgaatgggccggcagaaccaggcggctcgccgttcgcccgcaatctcgcggagctgccggaagcccaacgacgccacgaactggtggatctggtgtgcgcccaggtggcaaccgtgctcgggcacggcagtcgcgaggaagtccagcccgagcgggcgttccgcgcgctcgggttcgactccctcatggcggtggatctgcgcaatcgtttgaccaccgccaccgggttgcgcctgccgaccacaaccgtcttcgactacccgaatccggccgccttggccgctcacctgctcgaggagctggtgggtgatgtcgcgtcggctgcggtgaccgctgccagcgcgcccgcgagtgacgaaccgatcgcgatcgtcgcgatgagctgccggtttccgggtggcgcgcactcgccggaagacctgtggcggctggtcgccgccggcacggaggtgatcggcgagttcccctccgaccggggctgggatgcggaaggcctttacgatccggatgcttccaggcctggaacgacgtatgcgcggatggcgggattcctctacgacgccggtgagttcgatgccgacctgttcggcatcagcccacgtgaggcgttggcgatggatccgcagcagcggttggtgctcgaaatcgcctgggaagccctcgaacgggccggaatcgatccgttgtccttgaagggcagtggggtcggcacgtacatcggcgctggaagccgtgggtacgcgacggatgtgcggcagtttcccgaggaggcggagggctacctgctgacgggtacctcggccagtgtgctgtcgggtcgggtcgcgtattcgtttggtttcgagggtcctgcggtgacggtggatacggcttgttcgtcgtcgttggtggcgttgcatctggcgtgccagtcgttgcgttcgggcgagtgtgatctggcgttggccggtggtgtgaccgtgatgtcgacgccggagatgttcgtggagttctcccgtcagcgcggtttggcgccggatgggcggtgcaagtcgttcgcggagagcgcggacggcaccggctggggcgaaggcgcgggcctgttgttgctggagcggttgtcggacgcccaccggaatgggcatcgggtgttggcggtggttcgtgggtcagcggtgaatcaggacggcgcctcgaacggactggcggcgccgaacggtccgtcgcagcagcgggtgatcaaccaggcactcgcgaatgcggctctttcggcgtccgatgtggatgcggtggaggcacatggcaccgggaccaggctgggtgatccgatcgaggcgcaggcattgatcgcaacgtatgggcaggcccgggagcgggatcggcccttgtggctggggtcggtcaagtcgaacatcggtcatacgcaggccgcggcgggtgttgccggtgtgatcaagatggtgatggccatgcggcacgggcagctgcccgcctcgctgcacgcggatgagcccacgtcggaggtcgattggtcgtcgggggcggtccggctcctcgccgaacaggtaccttggccggagtctgaccgtgttcgtcgggtgggggtttcgtcgttcgggatcagcggcaccaacgcacatgtgatcctcgaacaagctacgaatgcgccagatagtacagcggagacggacaaaacagaatccggatctactgtcgatattccggtcgttccctggttggtgtcgggaaagacgacggattccctgcggggacaagccgaacgagtcttgtctcaggtcgagtcccggccggagcagcgttcgctggatgttgcctactcgcttgcttctggccgagccgcgctggatgaacgcgctgtcgtgctgggtgcggaccgcggtgagctggttgctggactggcggcgttggccgccggtcaggaggcttctggggtgatcagcggaactcgtgcttctgctcggttcgggttcgtgttctcggggcagggtggtcagtggttggggatgggcagagcgctctactcgaagtttccggtgttcgctgctgcgtttgatgaggcttgcgccgagttggaggcacatctgggggaagaccgccgggttcgggatgtggtcttcggttccgatgcgcagctgctggatcagacgctgtgggcgcagtcgggtctgttcgcgctgcaagccggcctcttggggctgctgggttcgtggggcgttcggccggatgtggtgatggggcattcggtcggggagttggccgccgcgtttgcggctggcgtgttgtcgttgcgggatgcggctcggttggtggccgcgcgcgcccggttgatgcaagccctgccctctgacggcgcgatgttggcggtggctgctggtgaagaccttgttcggccattgctggccggtcgggaggagtccgtgagcgtcgccgcgctcaatgcccccggttcggtggtgttgtcgggcgatcgggaggtgctggccagcatcgtcggccggctgaccgagctccgagtccggacgcggcgcttgcgggtctcccatgcttttcattcgcaccggatggacccgatgttgggcgagttcgcccagatcgccgagtctgcggagttcggtaagccaacgacaccgcttgtgtcgacgttgacgggtgagctcgacagagccgcggaaatgagcacaccagggtattgggtgcgccaggcgcgtgaacccgtccgtttcgccgacggtgtccaggccctggcagcgcagggcataggcacggtcgtcgagctcggcccggacggaacgctggcggcactggttcgggagtgtgcgaccgagtccgatcgggttgggcggatttcgtcgatcccactgatgcgcagggagcgggacgagacccgttcggtgatgacagccctggcgcatctccacacccgtggtggtgaggtggactggcaggcgtttttcgccggtaccggcgctaggcagctcgagttgccaacgtatgccttccaacgacagcactactggatcgagtccagtgcgcggccagcacgcgaccgcgcagacatcggcgaggtggcggaacagttctggaccgcggttgaccaaggcgatctggcaacgttggtcgccgctctggatcttggggcggacgacgacacatgcgcatcgttgagcgatgtattgccggcgttgtcctcctggcgaagcggactccgcaaccgttcgctcgtcgattcctgccggtaccgaatcagttggcattcctctcgggaggtgccggccccgaagatttccggtacctggctgttggtcgtgcccggtgctgcggatgacggattggtcacggctttgacgagttcactggtcggaggcggcgccgaggtcgtccggatcggcctgtccgaagaggacccgcaccgcgaggacgtcgcacagcggctggccaatgcgctgacggatgccggtcaactcggtggcgtgctttcgctgttggggctcgatgaatcgcctgctccgggattctcctgcttgccaactggtttcgcgctgactgtgcagcttctgcgggccttgcggaaggccgacgtcgaggcgcctttttgggcggtgacgcgcggcggcgtcgcgttggaagatgtacgcgtgtctccggagcaggccctggtctgggggctgctgcgtgtcgcgggactggagcacccggagttctggggtggcttgatcgacctgccatcggactgggacgaccgattgggtgcccggttggcgggtgtgttggcggatggtggcgaggatcaagtcgccattcgccgtggtggtgtgttcgtgcggcggttggaacgcgctggtgcgtcgggtgccgggtcggtgtggcgtcctcgggggacggtgttggtgacgggtggtacgggcggtttgggggcgcatgttgcccggtggttggccggtgccggggctgagcacgtggtgttgaccagccgtcgaggagcggacgctccgggcgctggggaattgcgggcggagctggaggcgctgggtgctcgggtgtcgattgtgccctgcgacgtggctgatcgtgacgcagtggctggagtgttggcagggatcggtggggagtgtccgctgactgcggtggtacacgccgccggggtcggcgaggcgggcgacgtagtggagatgggtttggcggattttgcagcggtgttgtcggcgaaggtgcgtggtgcggcgaatctggacgagttgctggccgactcggagctggatgcgtttgtgatgttctcctcggtgtcgggggtgtggggagccggcggacagggtgcgtatgcggctgcgaacgcctacttggatgcgttggccgagcagcgtcgggcgaggggattggtcgggaccgcggttgcgtggggaccgtgggccggtgacggcatggccgccggcgaaaccggcgcacagctgcaccggatgggcctggcgtcgatggaaccgagcgcggcgctgctggcacttcagggtgcattggaccgcgatgagacctccctcgtcgtggccgatgtcgattgggcacggttcgccccagccttcacctcggcacgtcgacgcccgctgctggacaccatcgacgaggcccgagccgcattggaaaccaccggcgaacaagcgggcacaggcaaacccgttgagctgacgcaacgcctggccggactgtcgcggaaggaacgcgacgatgcggtattggatctggtgcgggcggagacggcggctgtgctgggacgcgacgatgccacggccctggcgccatcgcggccgttccaggaactcggattcgactccttgatggcggtggagctgcgcaaccggctgaacaccgccaccgggatccagctgcccgccagcacgattttcgactaccccaatgccgagtcgctgtcgcgtcacctctgcgccgagcttttcccaacggagactaccgtggactcggcccttgccgagctcgatcgaatcgagcagcagctctcgatgctcaccggcgaagcgcgggcacgggaccgaatcgcgacacgactgcgagccctccacgagaagtggaacagcgcagctgaagtaccgaccggagccgatgtcctgagcacgctcgattcggcgacgcacgacgagatattcgagttcatcgacaacgagctcgacctgtcctgagcagttcctgcggaacttcaagcgccgaaatcgggtggaaatcacaatggccaatgaagaaaagctcttcggctatctgaagaaggtaactgcggacctgcatcagacccggcagcgcctgctcgcggccgagagccggagtcaggagccgatcgcgatcgtctcggcgagctgccgactgcccggcggcgtcgactctcccgaagcgctctggcaactcgtgcgcactggcaccgacgccatctcggagttccccgccgaccggggctgggatctcggccggttgtacgatcccgacccgaaccaccagggaacgtcgtacacgcgggccggcggtttcctcgcaggagcgggcgatttcgaccccgccatgttcgggatttcgccgcgtgaggcgttggcgatggacccgcagcaacggttgttgctggagctgtcctgggaggccctcgaacgggcgggcatagacccgacatccctgcgcggcagcaagaccggtgtcttcggtggtgtcacgccccaggagtacgggccgtccttgcaggagatgagccgaaacgctgggggttttggactcaccgggcggatggtgagtgtggcgtcgggtcgggttgcgtattcgtttggttttgagggtcctgcggtgacggtggatacggcgtgttcgtcgtcgttggtggccctgcatttggcgtgtcagtcgttgcgttccggcgaatgcgatctcgcgctggccggcggtgtgacggtgatggcgacaccggcgacgttcgtggagttctcccgtcagcgtggtttggctccggacgggcggtgcaagtcgttcgcggctgccgcggatggcaccgggtggggtgagggtgccggtctggtgttgctggagcggttgtcggatgcgcggcggaatgggcacgaggttctggcggtggtgcggggtagcgcggtgaaccaggacggcgcgtcgaatggtttgactgcgccgaatggtccgtcgcagcagcgggtgatcacccaggcgttggcgagtgcggggctgtcggtttccgatgtggatgcggtcgaggcacatgggaccgggaccacgttgggtgatccgatcgaggcacaggccctgatcgccacgtacgggcagggccgggagaaggatcggccgttgtggttggggtcggtcaagtccaacatcggtcacacgcaggcggccgctggcgttgccggcgtcatcaagatggtcttggcgatgcggcacgggcagctgcccgccacgttgcatgtggatgagcccacgtcggcggtggactggtcggcgggttcggtccggcttctcacggagaacacgccctggccggacagtggtcgtccttgccgggtgggggtgtcgtcgttcgggatcagcggcaccaacgcacatgtgattctcgaacagtctccagtcgagcagggcgaaccggccgggccggtcgaaggcgagcgggaaccggatgtagccgtccccgtggtgccttgggtgctgtcgggtaagacaccggaggctgcgcgggcgcaggccgaacgggtgcattcgcatatcgaggaccggccggggctgtcgccggtggatgtggcgtattcgctaggaatgacacgcgcggcgctggatgaacgcgcagtggtgttgggctcggaccgtgccgcgctcctgaccgggttgagggcattcgccgacggctgcgatgcgcccgaagtggtttcggggtctgtggggcttggtggccgcgtcgggttcgtgttctcgggtcagggtggtcagtggccggggatgggccgggggctctactcggtgtttccggtgttcgccgacgcgttcgacgaggcttgcgcggagttggatgcacacctgggccaggaactgcgggttcgggatgtggtgttcggttcgcaagcgtggttgctggatcggacggtgtgggcgcagtcgggtttgttcgcgttgcagattggcttgctgcggctgctgggttcgtggggtgttcggccggatgtggtgttggggcactcggtgggtgagctggctgcggtgcatgcggctggtgtgttgtcgttgtcggaggccgcgcggttggtggcgggtcgcgcccggttgatgcaggcgttgccttctggtggtgccatgctcgcggtcgctacgggtgagtttcaggtcgatcctctgctggatggggtgcgggaccggatcggtatcgcggcggtgaatggcccggaatcggttgtgctctctggtgaccgcgagctgctcaccgagatcgctgatcggttgcacgatcaggggtgccggacccggtggttgcgggtgtcgcatgctttccattcgccccatatggagccgatgctggaggagttcgcccagatctcccgaggccgcgaatatcacgcaccggaactgccgatcatctcgaccctgatcggtgagctggacggtggtcgagtgatgggcactcccgagtactgggtgcgtcaggtgcgtgagcccgtccgtttcgccgagggtgtccaggcgcttgtcggtcagggtgtcggcacgattgtcgaattgggtccggacggggcgttgtcgacgttggtcgaggagtgtgtggcggaatccgggcgggtggccgggatcccgctgatgcgcaaggaccgcgacgaggcgcgaaccgtgctggcagctttggcgcagatccacacccgtggtggtgaggtggactggcggtcgtttttcgccggtaccggggcgaagcaagtcgacctgcccacctacgccttccagcggcagcggtactggctggcatccaccgggcgtgcgggtgacgtgaccgccgccggattggccgaggcggaccatccgctgctcggtgcggtggttgcgttggcagacggcgaaggtgtggtgctgaccggtcggttgacagcgggttcgcatccgtggttgtccgatcaccgggtgctgggcgaaatcgtcgtccccggcaccgcgatcgtcgagctggtgtggcacgtcggcgagcgcctcggttgtggccgggtggaagaactggctttggaagcgcccctgatcctgccggatcatggagcggtccaggttcaggtgctggtgggaccgcccggggaatccggagcccggtcggtggcgctctactcctgtcctggcgaggcgatcgaacccgagtggaagaagcacgcgacgggcgtgcttctcccacccgtggccgccgagaaccatgagctgaccgcatggcccccggagaatgcgaccgaaatcgatgcagacggggtctacgcattccttgaagggcacggtttcgcgtacggaccggcctttagatgtctgcgcggtgcctggcgacgaggcggggaggtgttcgccgaagtcgcattgccggatgacatgcaggcgggggtcgatcgattcggcgtccaccccgcgttgctggacgcggttctgcatgccgccgcagccgagacgtcggtggtccagagcgaagcgcgggtgccgttctcgtggcgtggggtggaacttcgcgccactgaaagcgcggtggtgcgggcgcgcctctcgttgacttcggatgacgaactgtcgttggtcgcagtggacccggctggccgattcgtggccacggttgattcgctggtgacccgaccgatctcccggcagcaggtgaggtctggcgcgatcggtgattgcctgttcgaggtggagtggcaccggaaggcgttgttgggaacaaccgccggcgacgaccttgccatcgtcggtgacggtcccagttggccggaatcggtgcgcgcaaccgcacggttcgcgaccctggatgagttccgtgcggccgtggactcggacgttcctgccccgggttcggtgttggtcgcagctatgtcggccgaagaggtcgagggtggatccctgccgtcgcgcgcccaagagtcgacctccgatctgctggctctcgtgcagtcgtggcttgcggacgagcggttcgccgaatcccagctcgtggtcgtcacgcgtgcagcggtgtcggccgactcggattcggacgtcgcggacctggtgggtgcgtcgtcgtgggggttgttgagttcagcccagtcggagaacccgggtcgcttcgtgctggtggacgtggacggcacacctgagtcgtggcaggcgttgccggccgccgtgcgagcaggagaaccgcagctggcacttcggcgcggcgtggcgctggtgcctcggttggcgcgactcacggtgcgcgaggagggctcctccccgcaactcgacacggacgggaccgtcctcatcacgggtggcaccggtgcgttggggggagtggttgcccgtcacctggtggaggagcacgggattcggcgtttggtgttggcaggccggcgtggctggaatgcgcctggagtccacgagttggtggatgagctggcgcgcgcgggcgccgtggttgaggtggtggcttgcgatgtggctgaccgcaccgatctggagcacgtgctggccgccattccggtcgactggccgctgcgggggatcgtgcataccgctggggtgctggccgacggagtgatcgggtccttgtcggcggcggatgtgggcacggtgtttgccccgaaggtgacgggggcatggcatctgcacgagttgacccgcgatctggatctgtcgttcttcgttcttttctcttccttctccgggattgcgggtgccgcagggcaggccaactacgcggcggcgaacacgttcctggatgcattggcgcgttatcgccgggcgcgtgggctgcctgggttgtcgttggcgtggggactgtgggcgcaacccagcggtatgacgagtggcttggacgcggcgtcggtggagcggttggcgcggacgggcatcgcagaactttccacggaggatggactccgcctgttcgatgccgcgttcgcgaaggaccgggcttgcgtcgttgccgctcgattggacagggcgctgctggtcgggaacggacgatcgcacgcgattccggcgctgttgagcgcgttggttcctgttcgcggcggtgtggcgaggaaaacagccaattctcaggccgcggatgaggacgcactgttgggtttggtgcgggagcacgtttcggccgtgctgggttattcgggtgcggtcgaggttgggggcgaccgtgctttccgtgatctgggttttgattcgttgtctggcgtggagttgcggaaccgccttgccggggtgctgggggtgcggttgccggcgactgcggtgttcgactatccgacgccgcgggcgctggcgcgtttcctgcatcaggaactggcaggcgaggtcgcgtccacgtcgacgccggtgaccagggcagcgagtgccgaagaggatcttgttgcgattgtcgggatgggatgtcgttttccgggtggggtgtcgtcgccggaggagctttggcggctggtggccggcggcgtggatgcggtggctgggttcccagacgatcgcggctgggatctcgcggcgttgtacgatcctgatcccgatcgtctcgggacctcgtatgtgtgtgagggcgggtttctgcgggacgcggcggagttcgatgctgacatgttcggcatcagcccgcgtgaggcgttggcgatggatccgcagcagcggttgctgctggaggtcgcctgggaaaccttggagcgggctgggatcgatccgttctcgttgcacggcagccggaccggtgtgttcgcgggcttgatgtaccacgactatggggcccgattcattaccagagcaccggagggcttcgaagggcacctcgggacgggcaatgcggggagcgtgctgtcgggtcgggttgcgtattcgtttggtttcgagggtcctgcggtgacggtggatacggcgtgttcgtcgtcgttggtggcgttacacctggcgggtcaagcactgcgggccggtgagtgcgaattcgcccttgccggtggcgtcacggtgatgtcgacgccgacgacgttcgtggagttctcccgtcaacggggtctggctccggatgggcggtgcaagtcgttcgcggcggccgcggatggcaccgggtggggcgagggtgccggtctggtgttgctggagcggttgtcggatgcccggcgcaatgggcacgaggttctggcggtggtgcggggtagcgcggtgaaccaggacggcgcgtcgaatggcttgactgcgccaaatggtccgtcacagcaaagggtgatcacccaggcactcacgagtgccgggctgtccgtgtccgacgtggatgctgtggaggcgcatgggacgggcacgcggcttggtgatccgatcgaggcgcaggcgttgatcgctacgtacggccgggatcgtgatcccggtcggccgttgtggctggggtcggtgaagtcgaatattggtcacacccaggcggcggcgggtgtcgctggtgtgatcaagatggtgatggcgatgcggcagggggagctgccgcgcacgttgcacgtggacgagccctccgcgcaggtggactggtctgcgggcacggtccaactcctcacggagaacacgccctggcccgacagcggtcgtcttcgccgggcgggcgtgtcatcgttcgggatcagtggcaccaacgcgcacctgatccttgaacaacctccgcgagagtcgcagcgctcaacagagccggattcgggttctgtccgcgattttccggtggtgccgtggatggtgtcgggcaaaacacccgaagcgctatccgcccaggcagatgcattgatgtcctacttgagcaatcgcgttgatgcttccccgcgagatatcggttattcgcttgcggtgacccgtccggcgttggaccaccgcgctgtcgtgctgggtgcggatcgtgccgcgttgctgccgggcttgaaagcgctggccgttagtaatgacgctgccgaggtgatcaccggcactcgtgccgctgggccggtcggattcgtgttctccggtcaaggtggtcagtggcccgggatgggaagcgggctccactcggcgtttccggtgttcgccgacgcgtttgacgaagcctgctgcgagctggatgcgcatctcgggcagatggcccggctacgagatgtgttgtccggttcggatacgcaacttctggaccagaccttgtgggcgcagccgggcctgttcgcgttgcaagtcggactctgggagttgttgggttcgtggggtgtccggcccgctgtggtgctgggccactcggtcggtgagctggcggcggcgttcgcggctggagtgttgtcgttgcgggatgcggctcggctggtggcgggccgtgcccggttgatgcaagccctgccaactggcggtgccatgctcgctgcggctgctggagaggagcagctgcgcccgttgctggccgactgcggtgatcgtgtggggatcgccgcggtcaacgctcccgggtcggtggtgctctccggtgatcgggatgtgctcgatgacattgccggtcggctggacgggcaagggatccggtccaggtggttgcgggtttcgcatgcgtttcattcgcatcggatggatccgatgctggcggagttcaccgaaatcgcccggagcgtggactaccggtcgtcagggctgccgatcgtgtcgacgttgacgggtgagctcgatgaggtcggcatgccggctacgccggagtattgggtgcgccaggtgcgagaacccgtccgcttcgccgacggtgttgctgcgctcgcggctcacggtgtgagcaccgtcgtcgaggtcggtccggatggggtgttgtcggcgctggtgcaggagtgcgcggccggatccgatcagggcggacgggtggccgcggttccgctcatgcgcagcaatcgcgacgaggcgcacacggtgacaacggcattggcgcagatccatgtgcgtggtgctgaggtggactggcggtcgtttttcgccggtaccggggcaaagcaggtcgagctgcccacgtatgccttccaacgacagcggtactggcttgactcaccatccgaaccggtcgggcaatccgccgatcccgcgcgccagtcgggcttctgggaactcgtcgagcaggaagatgtcagcgcgctcagcgccgctctgcacattaccggcgatcacgacgtgcaggcgtccctggaatcggtggttccggtcctctcctcctggcatcgccggatccgcaacgaatccctggtgcaccagtggcggtaccggatttcctggcatgagcgggcagatttgccagacccctcgttgtcggggacatggctcgtcgtcgtgccggaggggtggtcggcgagtcggcaagttctgcgtttcaacgagatgttcgaggaacggggttgcccggcagttctgttcgagctcgccgggcacgacgaggaagccctggcgcaacgattccgctcgttgcctgttgcgtcagggggaataagcggcgtgttgtccttgctggcgctggatgaatcgccgtcctcgccgaacgctgctttgccgaatggcgcgctgaactcgttggtactgctgcgagctctgcgggccgcggatgtgtcggcgccattgtggttggcgacgtgtggtggtgtcgcggtcggggatgtgccggtgaacccggggcaggcgctggtgtggggactgggtcgcgtcgtcggtctggagcatccggcctggtggggtggcctggtcgacgtgccgtgcttgctcgatgaggacgctcgagaacgcttgtcggtcgtgttggcaggtcttggcgaggacgagatcgcggtacgtcccggtggtgtgttcgtgcggcggttggaacgcgctggtgcggcgtcgggtgccgggtcggtgtggcgtcctcgggggacggtgttggtgacgggtggtacgggcggtttgggggcgcatgttgcccggtggttggcgggtgccggggctgagcatgtggtgttgaccagccgtcgaggcgcggcggctccgggcgctggagatttgcgggcggagctggaggcgctgggcgctcgggtttcgatcacggcctgcgacgtggccgatcgtgacgctttggccgaagtgttggcgaccattccggatgattgcccgctgaccgcggtgatgcatgcggcgggggtcgttgaagtcggcgacgtggcgtcgatgtgtttgaccgacttcgttggggtgctgtcggcgaaggcaggtggtgcggcgaatctcgatgagttgctcgccgatgtcgagctggatgccttcgtgctgttctcatccgtctcgggtgtgtggggtgctggcgggcagggcgcttatgcggcggcgaatgcctacttggatgcgttggcgcagcagcgtcgggcaagggggttggtggggactgcggttgcgtggggcccgtgggccggtgacggaatggccgcaggtgaaggcggtgcacagctgcgccgggccggcctggtgccaatggctgcggatcgggcgttgctggcacttcagggcgcattggatcgtgacgagacatccctggtcgtggccgatatggcgtgggagaggttcgccccggtgttcgccatgtcccgtcggcgtccgctgctcgacgagctgcccgaagcacagcaggcgttggcggatgcggagaacaccactgatgctgcggactcggccgtcccgctaccgcggctcgcgggcatggcagccgccgaacgccgccgcgcgatgctggacctggtgctggcggaggcctcgattgtgttgggacacaacgggtctgacccagttggtcccgaccgggcgttccaggagctcggatttgattcgctgatggccgtcgaactgcgcaacaggttgggcgaggcaacaggattgagtctgccggccacgttgatcttcgattatccgagcccatccgcgctggctgagcagctggtcggcgagctggtgggagcgcagcccgcgaccaccgtcgtggccggggccgatccagtggatgatccggttgtcgtggtcgcgatgggatgccggtatccgggcgacgtctgctcgcccgaggagctgtggcagctggtttctgcgggacgtgatgcggtatcgacgttccccgtcgatcggggttgggactgcaacacgttgttcgacccggatccggatcgggcaggcagtacctatgtgcgagaaggtgccttcctgaccggtgctgatcggttcgacgccgggttcttcggcatcagccctcgcgaggcgcgcgcaatggatccgcagcagaggttgttgctcgaagtggcgtgggaggttttcgaacgagcaggaatcgctccgctgtcgttgcggggtagcaggaccggtgtgttcgcggggaccaatgggcaggaccacggtgcgaaagtggctgccgcgccggaggcggcgggtcacctcctgaccggaaacgccgcgagtgtcctggccggccggctttcctacacgttcggccttgaggggcctgcggtggcggtggataccgcgtgttcgtcgtcgttggtggcgttgcatttggcgtgccagtcgctgcgttcgggtgagtgtgatatggcgttggcaggtggtgtgacggtgatgtcgacacccctggctttcctcgagttctctcgtcagcgcggtttggcgccagatggtcggtgcaagtcgtttgcggccgctgcggatggcaccgggtggggtgagggtgccggcctggtgttgctggagcggttgtcggatgctcgtcggaatggtcaccgggtgttggccgtggttcgcgggtctgcggtgaatcaggatggtgcgtcgaatggcctgactgcgccgaatggtccgtcgcagcagcgggtgattcggcaggccctcgcgaatgcggggctgtcggcgtccgatgtggatgtcgtggaggcgcacgggaccggtaccgggctcggggatccgatcgaggcgcaggcgctgatcgcgacatatgggcaggagcgggatcctgagcgggccctgtggctggggtcgatcaagtccaacatcggccacacgcaggcggcggccggtgtggcgggggtcatcaagatggtgcaggccatgcggcacggggagttgcctgcgacgttgcacgtggacaagcccactccacaggtggactggtctgccggggccgttcggctcctcaccgggaacacgccctggcccgagagcggccgtcctcgtcgagcgggggtgtcgtcgttcgggatcagcggcaccaacgcacacctcatcctcgaacaaccaccgtcggaaccagcggagatcgaccaatcggatcggcgggtcactgcgcatccagcggtgatcccgtggatgttgtcggctaggagtctcgcagcgctgcaggcccaagcggctgcgctgcaggcccggctggaccggggtcctggcgcttctccgctggatttggggtattcactcgcgaccactcgttctgtgctggacgaacgcgccgtcgtgtggggtgccgatcgggaggcactgctgtccaggctggcagcgctcgccgatggccggacggcgccgggggtgataacgggctctgcgaattccggtggccgcatcggattcgttttttccggtcagggcagtcagtggctggggatgggaaaggcgttgtgcgcggctttcccggcgttcgcggacgccttcgaggaagcctgcgacgcgctaagcgcacacctgggcgcggacgttcggggtgtgctgttcggtgctgatgagcagatgctcgaccggacgctgtgggcgcagtcggggatcttcgcggttcaagtcggcctcctgggattgctgaggtcgtggggcgtgcggccggccgcggtgctggggcactcggtcggcgagttggctgcggcgcacgcggctggtgtgttgtccttgccggacgctgcacggttggttgcggctcgggcccacctgatgcaggcattgcccaccggcggcgcaatgctcgcggtcgccaccagcgaggcggcggtcggaccgctgctttccggggtgtgcgatcgggtcagcatcgctgcgatcaacggccccgagtcggtagtgctctccggcgaccgcgatgtgctcgtggagctcgcaggcgaattcgatgcccgagggcttaggaccaaatggttgcgggtctcccatgctttccactcgcaccggatggaaccgattctggacgagtacgcggaaaccgccaggtgcgtcgagttcggtgaaccggtggtgccgatcgtctccgccgcgaccggtgcgctggacaccaccggactgatgtgcgcggccgactactggacgcgccaagtgcgtgatcctgtccgcttcggagacggtgtccgggcgctcgtcggccaaggcgtggacacgatcgtcgagttcggcccggacggggcgttgtcggccctggtcgagcagtgcttggccgggtccgaccaggctgggagggtggcggcgatcccgctgatgcgcagggaccgcgatgaggtcgagaccgcggtggcggccctggcgcacgtgcacgtccgcggtggtgcggtggactggtcggcttgcttcgccggcaccggcgcccgcaccgtcgagttgcccacctacgccttccaacgccagcggtactggctggccgggcaagcggacgggcgcggcggcgatgtggttgccgacccggtcgacgcgcgcttctgggagttggtcgagcgcgccgatccggaaccgttggtggatgaactctgcatcgaccgggaccagcccttccgggaggtgctgcccgttctggcttcctggcgcgagaaacaacgccaggaggccctcgcggattcctggcgctaccaggtgcgctggaggtccgtcgaggtgccgtccgcagccgccctccggggcgtgtggctggtggtgcttccagctgacgtgccccgagatcaaccggcggtcgtcatcgacgcgctgatcgcgcgcggcgccgaggtcgcggtcctggaattgaccgagcaggacctccaacgcagtgcgcttgtggacaaggtgcgcgccgtcattgcggaccgcaccgaggtgacgggtgtgttgtctctgttggcgatggacggcatgccctgcgcggcgcatccgcacctgtcccgtggtgtcgccgctaccgtgatcctgacgcaggtgttgggcgatgcgggtgtttccgccccgctgtggctggccacgaccggtggcgtcgaggccgggaccgaggacggtccggccgatccggaccacggcttgatctgggggctcggcagggtcgtcggccttgaacatccgcagtggtggggtggcctgatcgaccttccggagacactggacgagacgtcccggaacgggttggtggccgcactcgccgggacggcggccgaagatcagctcgccgtgcgttcatccgggttgttcgttcgcagagtggtgcgcgcagcgcggaacccccggtcagagacatggcgtagccggggaacggtcctcatcacgggcggaacaggcgcgctcggtgccgaggtcgcacgatggctggcccggcggggagctgagcacctggtgttgatcagtcgccgcggcccggaagctcccggcgcagcggacctaggggccgagctgactgaactcggcgtgaaagtcacagtcttggcctgcgatgtgacggaccgcgacgagctggcggcggtgctggcggccgttcccacggagtatccgctgtcggcggtcgtgcacaccgccggcgtcgggacgcctgcgaacctggccgagacgaccttggcgcagttcgccgacgtgttgtcggccaaggtcgtcggcgcggcgaacctggaccggctgcttggcgggcaaccgttggacgccttcgtgctgttctcctcgatctcgggagtttggggagccggcggccaaggagcctattcggccgccaatgcgtatctcgatgcccttgccgagcgccgacgggcttgcgggcggccggcgacgtgcatcgcctggggtccgtgggcgggtgcgggcatggccgttcaggaaggtaacgaggcgcatctccgccgaaggggcctggtaccgatggaaccgcagtcggccctcttcgcgctgcaacaggccctgtcccaacgagaaaccgccatcaccgtcgcagatgtggactgggagcgattcgccgcctctttcaccgcggcccgcccgcgaccactgttggaagagatcgtggatctacggcccgacaccgagaccgaggagaagcacggtgccggcgagctggggcagcagctggccgcactgccgcccgctgagcgcggacacctgctgctggaggtggtgctggcggaaaccgccagcaccctggggcacgattcggcggaggctgtgcaacccgatcggaccttcgccgaactgggcttcgattcgctgaccgcggtagagctgcgcaacaggttgaacgcggtgaccgggcttcgcctgccgccgacgctggttttcgaccacccgacgccgctggcgttgtccgaacagttggttccggccctggtcgcggagccggacaacggcatcgaatcgctgctcgccgagctcgacaggctggataccacgttggcgcaagggccttcgatcccactggaagaccaggccaaggtggcggagcgcttgcacgcactcctcgccaagtgggacggggcgcgtgacggcacggccagagcgacgtcaccccaatcgctgacggcggccacggacgacgaaatcttcgacctcatcgaccggaagttccggcgctgaccgccctttcctcgcctcagctcccctgattactggaacggtgtatttcgatggccaatgaagaaaagctccgcgagtacctcaagcgtgtcgtcgtcgaactggaagaggcgcacgaacgcctgcacgagttggagcgccaggagcacgaccccatcgcgatcgtgtcgatgggatgtcgttatcccggtggcgtctccactccggaggagctgtggcgactggtcgtcgacggaggagacgcgatcgcgaacttccccgaagaccgtggctggaatctggacgagctgttcgatcctgatccgggccgagccgggacctcctacgtccgcgagggtggtttcctgcgcggggtcgcggacttcgatgccgggctcttcgggatcagtccgcgcgaggcacaggcgatggacccgcaacagcggttgctgctggagatctcgtgggaggtgttcgagcgcgccggcattgacccgttttctttgcggggtaccaagaccggtgtgttcgcgggcctgatctaccacgactacgcgtcgcggtttcgcaagacccccgcggagttcgagggttacttcgccaccggcaacgcgggcagcgtcgcatccggccgggtggcttacaccttcgggttagagggcccggcggtcaccgtggacaccgcctgctcgtcgtccctggtggcgctgcacctggcctgccagtccctgcggctgggcgaatgcgacctggccctggccggtggcatttcggtgatggccacgccgggagccttcgtcgagttcagccggcaacgcgcactcgcctcggatggccggtgcaagcccttcgcggatgccgccgacggcaccggctggggcgagggcgccggaatgctgctgctggaacggctgtcggacgcacgacgaaacggccacccggtgctggcggcggtggtcggttccgcgatcaaccaggacgggacgtccaacggcctgaccgcgcccagcggtcccgcacagcagcgagtgatccgccaagccctggcgaacgccgggttgtcgcccgccgaggtcgatgtggtcgaggcgcacggcacgggcacggccttgggcgacccgatcgaggcgcaggccctgatcgccacctacggggcgaaccggtcggcggatcatccgctgctgctgggttccctcaagtcgaacatcggccacacccaggctgccgccggtgtggccggggtgatcaagtcggtcctggccatcaggcaccgggagatgccccgcagcctgcacatcgaccagccatcgcagcacgtggactggtcggcgggcgcggtgcggctgctcacggacagcgttgactggccggatctcggcaggccgcgccgagcaggggtgtcctcgttcggcatgagcggtaccaacgcacacctgatcgtcgaggaagtatccgacgagccggtctcgggcagtaccgagccgaccggggcatttccctggccgctgtccggcaagacggagacggcattgcgcgagcaggctgccgagttgctctccgtagtgaccgagcacccggagccgggactgggggacgtcgggtactcgctggccaccggtcgcgctgcgatggagcaccgggctgtcgtggttgccgacgatcgggactctttcgtcgccggactgacggcgttggctgcgggcgttccggcagccaacgtggtgcagggcgcggccgactgcaagggaaaggtcgcgttcgtgttccccggccagggctcgcattggcaggggatggcgagggaactgtccgaatcctcgccggtgttccggcggaagctggcggaatgcgcggcggctacggccccttacgtggactggtcgctgctcggcgtccttcgcggtgatcccgatgcacccgcgctggatcgcgacgacgtgattcagctcgcgctgttcgccatgatggtgtcgctggccgaactgtggcgttcgtgcggagtggagcccgccgcggtggtcggtcattcccagggcgagatcgccgccgcccatgtggcaggcgctttgtccttgactgatgcggtgcgcatcatcgctgcccgctgcgatgcggtgtcggcgctgaccgggaagggaggcatgctcgcgattgccttgccggaaagcgcggtggtgaagcgaatcgcaggcctgccggagctgaccgttgcggcggtcaacggacccggctccactgtcgtttccggcgaaccgtcggctctggagcgtctgcagaccgaactgaccgcggaaaacgtgcagacccggcgggtgggaattgattacgcctcgcattcgccgcagatcgcgcaggtccagggccggcttctggaccggctgggcgaagtcgggtccgaacctgctgagatcgctttctactcgacggtcaccggcgagcggacggacaccggccgactcgacgccgactactggtaccagaaccttcggcagcccgtccgcttccagcagaccgtcgcccggatggcagatcagggctatcggttcttcgtcgaggtgagcccgcacccgctgctcaccgccggaatccaggaaacgctggaagccgcggacgcgggcggggtggtggtcggttcgctgcggcgtggcgagggcggctcccggcgctggctgacttcgctggccgagtgccaggtgcgcggactgccggtgaattgggaacaggtattcctcaacaccggagcccgacgcgtgccgctgccgacctacccgttccagcggcagcggtactggttggagtccgccgagtacgacgcgggcgatctcggttcggtgggcttgctctccgccgagcatcccctgctcggggctgcggtgacgctggccgatgcgggcgggttcctgctgaccggcaagctgtcggtcaagacccagccctggttggccgaccacgtggtcggcggggcgatcctgctgcccggcaccgcgttcgtggaaatgctgatacgcgccgcggaccaggtcgggtgcgatctgatcgaggagttgtccctgacgactccgctggttttgcccgcgaccggtgcggtgcaggtgcagatcgcggttggcggtccggacgaggccgggcgccgctcggtccgcgtgcattcctgtcgagacgacgccgtgccgcaggactcgtggacctgccacgcgaccggcacgttgacctccagcgatcaccaggacgccggccagggccccgatgggatttggccgcccaacgatgctgtcgcggttccgctggacagcttctacgcccgcgcagctgagcggggcttcgatttcggcccggcgttccaggggttgcaggcggcttggaagcgcggagacgagatcttcgccgaggtcggcctgcccaccgcacaccgcgaagacgccggcaggttcggaatccaccctgctctgctggatgcggcactgcaggcgctgggcgcagccgaagaggatccggacgagggatggctcccgttcgcgtggcaaggtgtgtccctcaaagcgacgggcgcactttcccttcgggtgcacctcgttccggcgggcgcgaatgcggtgtcggtgttcacgaccgacacgactggccaagccgtgctctccatcgattcgctggtgctgcgccagatttcggacaagcagttggcagcggcccgtgcgatggaacacgagtccctgttccgggtcgactggaagcgaatctcgcccggcgctgccaagccggtctcctgggcagtgatcggcaatgacgaactcgcccgagcctgcggctcggcacttggcacggaactccaccccgacctgaccgggttggctgacccgcccccggacgtcgtggtggtgccatgcggtgcgtctcgccaggacttggacgttgcttccgaggcacgtgccgcgacacaacgcatgcttgacctgatccaggattggttggcggcggcgcgattcgccggatctcgcctggtggttgtgacgtgtggtgcggcgtcgacaggtcccgccgagggtgtttccgacctggtgcatgctgcgtcgtggggtttgttgcgttcggcgcagtcggagaacccggaccgattcgtgttggtcgatgtggacggaaccgccgaatcatggcgtgcgctcgcggcggccgtgcgttccggagaaccgcagctggcgttgcgcgccggtgaagtccgggtgcctcgcctggcgcgatgtgttgccgccgaggacagccggatcccagtgcccggtgcggatgggacggtgttgatttccggcggtacgggcctgctgggcgggttggttgcccggcatttggtggcggagcgcggtgtccgccgcctggtgctcgcggggcgacgcggctggagcgcccccggggtcaccgacctggtggatgagttggtgggcctgggagctgcggtcgaggtggcgagctgcgatgtcggggatcgggcccagttggaccggctgctgacgacgatctcggcagagttcccgctgcgcggagtggtgcatgcggccggggcacttgccgacggggtcgtcgagtcgctgacaccagagcacgtggcaaaggtgttcggcccgaaggccgccggtgcgtggcacctgcacgagttgactcttgatctggatctctcgttcttcgtgctcttctcctcgttctccggcgtggcgggggctgcgggtcagggaaactacgcggcggcgaacgcgttcctggacggcctggctcagcaccggcggacggcggggctgcctgcggtgtcgctggcttggggcttgtgggagcagcccagcgggatgaccggagcgctcgatgcggcgggccgtagccgcattgcgcgcaccaatccgccgatgtccgcgccggacgggttgcggctgttcgagatggcgtttcgcgttccgggcgaatcgcttctggttccggtccacgtcgacctgaacgccctgcgcgctgatgcggccgacggcggtgtgcctgcgttgttgcgcgacctggtgccagcgcccgtgcggcggagcgcggtcaacgagtcggcggacgtcaacggtctggttggtcggctgcggaggctgccggacctggatcaggaaacccagctgttgggtttggtgcgcgagcatgtttcggcggtgctggggcattcgggtgcggtcgaggtcggggccgatcgtgctttccgggatttgggttttgattcgttgtccggtgtggagtttcggaaccggcttggcggggtgctgggcgttcggttgccggctactgcggtgttcgactatccgacaccgcgggcgttggttcggttcttgctcgacaaactgattggtggcgtggaggctccgactcccgcaccggcggctgtggcggcggtgactgctgacgatcccgttgtgatcgtggggatgggctgtcgttatccgggtggggtgtcctcgccggaggagctttggcgtttggtggccgggggcttggatgcggtggcggagttcccggacgatcgtggctgggatcaggcggggttgttcgatccggatcccgatcgtcttgggacctcgtatgtgtgtgagggtggcttcctgcgagatgcggcagagttcgatgccggtttcttcgggatttccccgcgtgaggcgttggcgatggatccgcagcagcggttgctgctggaagtcgcttgggaaaccgtggagcgggcggggattgatccgctttcgttgcgggggagccggaccggcgtgttcgcggggctgatgcaccacgactacggcgcgcggttcatcacgagggcgccggagggtttcgagggttatctaggtaatggcagcgcgggaggcgtgttttcgggtcgggttgcgtattcgtttggtttcgagggtcctgcggtgacggtggatacggcgtgttcgtcgtcgttggtggcgctgcacctggcgggtcaagcactgcggtctggtgagtgtgatctggctcttgcgggtggtgtgacggtgatggccacgccggggatgttcgtggagttttcgcgtcaacggggcttggcggcggatgggcggtgcaagtcgtttgcggcggctgcggatggcaccggttggggagaaggcgcgggcttggtgttgttggagcggctgtcggatgcccggcgcaacgggcacgcggttctggcggtcgtgcggggtagcgcggtgaatcaggatggtgcgtcgaatggtttgacggcgccgaatgggccctcgcagcagcgggtgatcacgcaggcgttggcgagtgctggtttgtcggtgtctgatgtggacgccgtggaggcgcatgggactggaaccaggcttggtgatccgattgaggcgcaggctctgattgccacttacgggcaggggcgggatagcgatcggccgttgtggttggggtcggtgaagtcgaatattggtcatacgcaggcggcggcgggtgtcgctggtgtgatcaagatggtgatggcgatgcggcacgggcagctgcccgcgacgttgcatgtggatgaacctacgtcggaagtggattggtcggcgggggatgtccagctcctcacggagaacaccccctggcccggcaacagccatcctcggcgggtgggcgtgtcgtcgttcgggatcagcggcaccaacgcacacgtcatcctcgaacaagcctcgaaaacaccagacgagactgcggacaagagcggtcccgattcggaatcgaccgtggaccttccagcggtcccgttgatcgtgtcggggagaacaccggcagcgctcagcgctcaggcgagcgcattgttgtcctatttgggtgagcgtggcgatatttccacgctggatgcggcgttttcgttggcttcctcccgggccgcgttggaggagcgggcggtggtgctgggagcggaccgcgaaacgttgttgtccgggttggaagcgctggcttccggtcgcgaggcttctggggtggtgtcgggatccccggtctctggcggggttgggttcgtgttcgccggtcagggcggacagtggttggggatgggccgggggctctactcggtttttccggtgttcgctgacgcgtttgacgaagcatgtgccggactggacgcgcatctggggcaggacgtgggggtccgggatgtggtgtttggttccgacgggtccttgttggatcggacgctgtgggcccagtcgggtttgttcgcgttgcaggttggtttgctgagcctgctgggttcgtggggtgtccggccgggtgtggtgctgggccattcggtcggcgagttcgcggcggcggttgcggcgggagtgttgtcgttgccggatgcggctcggatggtggcgggtcgtgcccggttgatgcaggcgttgccttctggcggtgccatgttggcggtggctgctggtgaggagcagctgcggccgttgttggccgatcgggttgatggtgcgggtatcgccgcggtcaacgctcctgagtcggtggtgctctccggcgatcgggaggtgcttgacgacatcgccggcgcgctggatgggcaagggattcggtggcggcggttgcgggtttcgcatgcgtttcattcgtatcggatggacccgatgttgcaggagttcgccgaaatcgcacgcagcgtggactaccggcgtggcgacctaccggtcgtgtcgacgttgacgggtgagctcgacaccgcaggtgtgatggctacgccggagtattgggtgcgtcaggttcgagagcccgtccgcttcgccgacggcgtccgggtgctcgcgcagcaaggggtcgccacgatcttcgaactcggccctgatgcgacgctgtcggccctgattcccgattgtcattcgtgggctgatcaggccatgccgattccgatgctgcgtaaagaccgtacggaaaccgaaactgtggtcgccgcggtggcgcgggcgcacacgcgtggtgttccggtcgaatggtcggcgtatttcgccggcaccggggcacggcgggtcgagttgccgacgtatgccttccagcggcagcggtactggctggaaacatcggattacggcgatgtgacgggtatcggcctggctgcggcggagcatccgttgctgggggccgtggttgcgctggccgatggtgatgggatggtgctgaccggccggttgtcggtggggacgcatccgtggctggcccagcatcgcgtgctgggcgaggtcgtcgtccccggcaccgccatcctggagatggccctgcacgcaggggcgcgtctcggctgtgaccgggtggaagagctcaccctggaaacaccgctggtggtccccgaacgcgcggcgggtgccggtagtcgtggccctgcgggagggaccacagtttcaattgaaactgcggaagaacgtgtgcggacgaacgacgccatcgaaatccagctgctggtgaacgcacccgacgaaggcggtcggcgaagggtgtcgctgtattcccgcccggccggtgggtcgagaggtgggggttggacgcgccacgccaccggcgaactcgtcgtcggcaccaccggtggtagggcggttcctgattggtcggctgagggtgccgagtcgattgctctcgatgagttctacgtcgctctggccggaaacgggttcgagtacgggccgttgttccaggggcttcaggcggcatggcgtcgtggtgacgaggttctcgccgaaatcgccccgccggccgaggccgatgcgatggcgtcgggatacctgctcgacccagcgttgctggatgccgcgctgcaggcgtccgcgctcggcgaccgcccggagcaaggcggcgcgtggctgccgttctcattcaccggcgtcgaactttccgctccggcagggacgatcagcagggtgcggctggagaccaggcgacccgacgcgatatcggtggccgtgatggatgagagtgggcggttgctcgcctcgatcgattctctcaggctacgaagcgtgtcgtcgggacagctggcgaatcgggacgctgtccgcgacgcgctgttcgaggtgacctgggagccggtggcgacgcagtcgacggaaccgggtcgctgggccctgcttggtgatactgcctgcggtaaagacgatctcatcaaactcgcaacggattccgccgaccgctgcgcggatctggcggcgctagccgagaaacttgattccagcgcgctggttcctgatgtcgtggtctactgcgccggagaacaggcggatcccggcaccggcgcagccgcacttgcggagacccagcagacgttggctctgctccaagcgtggttggctgagccgcggttggccgaggcacgtctggtggtggtgacgtgtgcagcggtgacgacggctccgagtgacggtgcatcagagctggcacatgcgccgttgtgggggttgttgcgtgccgcgcaggtggagaacccggggcagtttgtgctggcggacgtcgacggaaccgccgaatcgtggcgtgcgttgccgagtgcgttgggctcgatggaaccgcagttggccctgcggaagggcgcggtgcgagcgccccgcttggcttcggtcgccgggcagatcgacgtgcccgcggttgtggcggatcccgaccgaaccgtgctgatttcgggcggcacgggcctgttggggggcgcggttgcccgccacctggtgaccgaacgcggtgtccgccgattggtgttgacgggccgtcgtggctgggatgctcctggaatcaccgagttggtgggtgagctgaacggcctcggtgccgtggtcgacgtggtggcgtgcgacgtcgcggatcgtgctgatctggagtcgttgctggcggcggtcccggcggaatttccgttgtgcggcgtggtgcatgccgcgggggcgctggccgacggggtgatcgagtcgttgtcaccggacgacgtgggagcggtgttcggcccgaaggcggcgggggcgtggaatctgcacgagctgactcgtgatacggacctgtcgttcttcgcgttgttctcctcgctttccggtgttgccggcgctcctggtcagggcaattatgcggcggcgaacgcgttcctggacgcattggcgcattaccggcggtcacagggactgcctgcggtgtcgctggcctggggcctgtgggagcagccgagcgggatgacggagacgctcagcgaggtcgaccggagcaggatcgcgcgcgccaacccgccgttgtccaccaaggagggattgcggctgttcgatgccgggctggcgctggaccgggcagcggtagttccggcgaagttggacaggactttcctggccgagcaggcgcggtcgggctcgctgcccgcattgttgacggcactggtaccccccatccgtcgtaataggcgggctagcggaaccgagctcgcggacgagggcaccctgctcggggtggtgcgggagcatgccgcggccgtgctggggtattcgagcgcggctgacgtcggggtcgagcgcgctttccgggatctgggttttgattcgttgtctggtgtggagttgcggaaccgccttgccggggtgctgggggtgcggttgccggcgactgcggtgttcgactatccgacgccgagggcgctggcccggttcctgcaccaggaactggcagacgagatcgctacgacgccagcgccggtgacgacgaccagggcaccggtcgccgaagacgatctcgtcgcgatagtcgggatgggatgccgttttcccggtcaggtgtcctcgccggaggagctctggcgtttggtggccgggggcgtggatgcggtcgcggacttcccagccgatcgcggctgggatctggcaggcttgttcgatccggacccggaacgggctgggaagacctacgtgcgggaaggggccttcctcaccgacgccgatcggttcgatgcgggtttcttcgggatttccccgcgtgaggcgttggcgatggatccgcagcaacggctgttgctggagctgtcctgggaggccattgaacgggcagggatcgatccgggttcgctgagggggagtcggaccggtgtgttcgcggggctgatgtaccacgactatggcgcccggttcgccagccgagccccggaaggtttcgaggggtatctcggcaatggcagtgctgggagtgtcgcgtcgggccggattgcgtactcgtttggtttcgagggtcctgcggtgacggtggatactgcgtgttcg

SEQ ID NO: 6 - DNA, 29736 bp, Saccharopolyspora spinosa
tcgtcgttggtggcgttgcatttggcgggtcagtcgttgcgttccggcgaatgcgatctcgcccttgccggtggtgtgacggtgatgtcgacgcccgggacgtttgtggaattctcccgtcagcggggcctggcaccggacgggcggtgcaagtcgttcgcggagagcgcggacggtaccggttggggtgagggtgctggtttggtgttgttggagcggttgtcggatgctcggcggaatgggcatcgggtgttggcggtggttcgtgggtcggcggtgaatcaggatggtgcgtcgaatggcttgaccgcgccgaatggtccctcgcagcagcgggtcatccagcaggcgttggcgagtgcgggtctgtcggtgtccgatgtggatgccgtggaggcgcatgggaccgggaccaggttgggtgatccgattgaggcgcaggctctgattgctacgtatgggcgcgatcgtgatcccggtcggccgttgtggttggggtcggtgaagtccaacatcggtcatacgcaggcggcggcgggtgttgccggtgtgatcaagatggtgatggcgatgcggcacgggcaacttccgcgcacgctgcacgtggatgcaccctcctcgcaggtggattggtcggcggggagggtccagctcctgacggagaacacgccctggcccgacagtggtcgcccctgtcgggtgggggtgtcgtcgttcgggatcagcggcaccaacgcgcacgtcatcctggaacagtccacggggcagatggatcaggcagcggagccggattcgagtcctgttctggatgttccggtggtgccgtgggtggtgtcgggcaaaacacccgaagcgctatccgcccaggcggcaacgttggcgacctatttggaccaaaatgttgatgtctcccctctggacgttgggatttcgcttgcggtgacccgttcggcgctggatgagcgggcggtggtgctggggtcggatcgtgacacgttgttgtctggcctgaatgcgctggctgccggtcatgaggctgctggcgtggttacgggacctgtcgggattggtggccggaccgggtttgtgttcgccggtcaaggcggtcagtggttggggatgggccgccggttgtactcggagtttccggcgttcgccggtgctttcgacgaagcatgcgccgagctcgatgcgaacctggggagggaagtcggggttcgggatgtggtgttcggctccgacgagtccttgctggatcggactttgtgggcgcagtcgggtttgttcgcgttgcaggtcggtctctgggaattgttgggtacgtggggtgttcggcccagcgtagtgctggggcattcggtcggggagctagccgcggcgttcgccgcaggtgtgctgtcgatggcggaggcggctcggctggtggcgggtcgtgcgcggttgatgcaggcgttgccttctggcggtgccatgctggcggtgtccgcgaccgaggcccgagtcggcccgctgctcgatggggtgcgggatcgtgttggtgtcgcagcggttaacgctccggggtcggtggtgctttccggtgaccgggatgtgctcgatggcattgccggtcggctggacgggcaaggtatccggtcgaggtggttgcgggtttcgcacgcgtttcattcgcatcggatggatccgatgctggcggagttcgccgagctcgcacggagcgtggactaccggtctccacggctgccgattgtctcgacgctgaccggaaacctcgatgacgtgggcgtgatggctacgccggagtattgggtgcgccaggtgcgagagcccgtccgcttcgccgacggtgtccaggcgcttgtggaccaaggcgtcgacacgattgtggaactcggtccggacggggcgttgtcgagcttggttcaagagtgtgtggcggagtccgggcgggcgacggggattccgttggtgcggagagaccgtgatgaggtccgaacggtgctggacgctttggcgcagacccacactcgtggtggcgcggtggactgggggtcatttttcgctggtacgagggcaacgcaagtcgaccttcccacgtatgccttccaacgacagcggtactggctggagccatcggattccggtgatgtgaccggtgttggcctgaccggggcggagcatccgctgttgggtgccgtggtgccggtcgcgggcggcgatgaggtgctgctgaccggcaggctgtcggtggggacgcatccgtggctggcggaacaccgcgtgctgggcgaagtcgtcgtccccggcaccgcgttgctggagatggcgtggcgggccggtagccaggtcggttgtgaacgtgtggaggagctcaccttggaggcaccgctggtcctgccggagcggggcgctgcggcggtgcagttggcggtgggggctccggatgaggccggccggcgcagtttgcagctctattcccgaggcgctgatgaagacggcgactggcggcggattgcctccgggctgttggcccaggccaatgcggtgccgccggcggattcgacggcatggccgccggacggcgccgggcaggtcgatctggcggagttctacgagcgcctcgccgagcgcggcttgacctacggtccggtattccaagggctccgcgccgcatggcggcacggcgacgatatcttcgccgaattggccgggtcaccagacgcctcgggtttcggcatccacccggcgctgctggacgctgcactgcacgcgatggcgcttggtgcttcgcccgactcggaagcgcgtctgccgttttcctggcgtggcgcccagctgtaccgcgctgaaggagcagcgcttcgggtacggctctcgccgctgggctccggtgcagtctcattgacgttggtggatgccacagggcgacgagtcgctgcggtggaatcgctttcgacgcgaccggtctccaccgaccagatcggtgccggtcgcggcgatcaagagcggctgctgcacgtcgagtgggtaaggtcggctgaatctgcggggatgtctctgacctcctgcgcggtggtcggtttgggcgaaccggagtggcacgctgcgctgaagaccactggtgtccaagtcgagtcccatgcggaccttgcttcgttggccaccgaggttgccaagcggggttcagctcctggtgcggtcatcgtcccgtgcccgcgaccccgagcgatgcaggagctgccgaccgccgcgcgaagggcgacgcaacaggcgatggcgatgctgcagcaatggcttgccgatgaccggttcgtcagtacgcgcctgatcctgctgacgcatcgggcggtctccgcagttgctggagaagacgtgctcgacctggtacacgcgccgctgtggggcttggtccgcagcgcgcaagcggagcacccggaccgattcgccttgatcgatatggacgacgagcgagcatcgcagacggcactcgccgaagcgctgactgcgggagaagcgcagctcgcggtgcggtcgggagttgtgctggcgccccgcctcggccaggtgaaggtgagtggaggtgaagcgttcaggtgggatgaaggcaccgtgctggtcaccggcggaaccggcgggctcggggccctgctcgcacgccatctggtcagcgcccacggtgtgcggcacctgttgctcgcaagtcgccgtggtctggcggcgcccggagcggatgagctggtggccgagctggagcaggccggcgccgacgtcgcggtcgtcgcgtgcgactcggcagatcgggactcgcttgcgcggctggtggcgtcggtgcctgcggaaaacccgttgcgggtggtggtgcacgccgccggtgtgctggatgacggtgtgctgatgtcgatgtcgccggagcgcttggacgcggtgttgcggcccaaagtggatgccgcgtggtacctgcacgagctgactcgggaactcggtctgtcggcgttcgtgttgttctcctcggtcgcgggcctgttcggcggtgcggggcagagcaattacgctgccggcaacgctttcctggatgccttggcgcattgccggcaggcccaggggctgcccgcgctgtcgctggcctccgggctgtgggcgagtatcgatggaatggcgggcgacctcgctgcggcagatgtggagcggctgtcgcgggcaggcattggcccgctttcggcaccgggagggctggccttgttcgacgctgccgttggctcggacgaaccgttgctggcaccggtgcgactggatgtcgaagcactgcgtgtgcaggcccgatccgtgcagacccggattccggaaatgctgcatggcatggcaatggggccaagccgccgcactccgttcacttccagggttgagccgttgcacgaacggctggccggattgtcggagggcgaacgtcggcagcaagtgctccagcgcgtccgcgccgatatcgcggtggtactggggcacggcaggtcgagcgatgtggacatcgagaagcctttggccgagctgggtttcgactcgctgacggccatcgaactccgcaaccgtctcgctaccgccaccggactgcggcttcccgcgacgctggccttcgaccacggcactgcggcggcactcgcccagcacgtgtgcgcgcagctaggcaccgcgaccgcgccggcaccgaggcgaaccgacgacaacgacgccacggagcccgtgaggtcgctcttccaacaggcgtatgcggctggccggatacttgacgggatggatttggtgaaggtcgctgcccagttgcgaccggtgttcggttcgcctggcgagctggaatccctgccgaaacccgtccagctttcccgtggtcccgaagagcttgccttggtgtgcatgccggcgctgatcgggatgccgcccgcacagcagtacgcgcggatcgccgccgggttccgcgatgtgcgggacgtttcggtgatcccgatgcctggattcattgcgggagaaccgctgccgtccgccatcgaggtggcggttcggacgcaggcggaggcggtgctgcaggaattcgccgggggctcgttcgtactggtcgggcattcctccgggggctggctggcgcacgaggtagccggtgagctggagcgtcgcggggtcgtcccggccggggtcgtactgctggacacctacatccccggtgagatcacgccgaggttctccgtggcgatggcccaccggacgtatgagaagctcgcgactttcacggacatgcaggatgtcggtatcaccgcgatgggcgggtacttccggatgttcaccgagtggactccgacgccgatcggtgctccgacgctgttcgtgcggaccgaagattgcgtcgcagaccctgaagggcggccgtggacagatgactcctggcggccagggtggactctcgcggatgccacggtccaggtgccgggcgaccacttctcgatgatggacgagcacgccgggtccaccgcacaggcagtcgcgagttggcttgacaaactcaaccagcgcaccgctcggcaacgctgacgggcgtccttttaggaccttctgggcggcaccggccaccccggcggtgccgccttccgtggtccaggctcgccgatcttgacggcgcacgatgcgcggcacgcgcgctgatcgtgattccgctgccgctcgtggccatcggcctggcgaatcatgtcctttcgggcaacgtcaaacgaattcgtccgagcccgcattccgaggtgaggggcacccttgggtggctgagccgctcaagggtgcccctcacctcgaaattcgtccgatttgggcggtggacgcaaccccggtgggcgtggtgcgtctttcttgttgacagagcggtgagaagccgctgacacacctgagaggaaaaggggagcatgatgctcaagcgccaccgtttgacgaccgccatcaccggccttctggggggagtactgctggtcagcggctgcggaaccgccgccgcacttcagtcctcgccggcgcccgggcatgacgcgcgcaatgttggtatggcctcgggcgggggcggcggggacatcggcacgtcgaactgctcggaggccgatttcctcgccaccgcgacaccggtgaaaggcgaccccggcagtttcatcgtggcgtacgggaaccggtcggacaagacctgcacgatcaacggcggcgtgccgaacctcaagggcgtggacatgagcaactcgccgatcgaggacctgccggtcgaggacgtgcggcttcccgacgcgcccaaggaattcaccctccagcccggtcagagcgcgtacgccggcattggcatggtcctggccgacagcggcgacccgaacgcccatgtcctcaccgggttccagtcctcgctgccggacatgtccgaggcccagccggtcaacgttctcggcgacggcaacgtgaagttcgccgcgaagtacctgcgagtcagctcgctggtgtctaccgcagacgagctgcgctaaaacccatgtgagtcccgcagattcgacctcgccgtgcggcgcctccggcgaagcgtccgtacgtttgtcgttgtgaccagcgttgttcacgtccgggcgcagcgctggtacatactcaggcgtctcgggcgcctccaacggggcctggcatccggggccgtcgagtgcggcggcgctgacgcgttctctgtcgggcgttgtcacgccgccggcctcgaaccggtcccgccccgtcggagccggtggtccagcgcggtgtggcggcggccggagccgacggtgcgcaccgcctgcccgagggcctttttcgaaccgacgaggaccacgaccttcttggcccgggtgaccgccgtgtagagcaggttgcgctgcagcatcatccaggcgcttgtggtcaaggggatcaccacgcacgggtattcgcttccctgcgaacgatggatggtcaccgcgtaggcgtggaccagttcgtcgagttctgtgaagtcgtagtcgatgtcctcgtcctcgtcggttcgcacggtcatggtctgtgcttcgttgtcgagggcggacacgacgccctgcgtgccgttgaacacgccgttggcgcccttgtcgtagttgttgcggatctgcgtgaccttgtcgccgacgcggaagatccgtccgccgaaccgccgctctggcaggccctccctggccggggtgatcgcttcctgcaacagctggttcagcgcgcctgcacctgcggggcctcgatgcatcggggcgaggacctgcacgtcggtgcgcgggttgaaccggaacttccgcggaatccggcgggcgacgacgtcgacggtgagctcggcggtcggttcgctttcctctacgtggaacaggaagaagtcggtcagcccgtgtgtcagcggatagtccccggcgttgattcggtgcgcgttggtcaccaccccggactcggcggcctgccggaacacctcgttgagccgcacgtgtggaatcggggtgccaggggcgagcagatcgcgcagtacctcaccggctccgaccgacgggagctggtcgacgtcgccgaccagcagcaggtgcgcgccgggcgcgatcgccttggccagtttgttggctaacagcaggtcgagcatggacgcctcgtcgaccacgacgaggtcggcgtccagcgggttgtcccggtcgtaggcggcgtccccgcccggctggagttggagcaggcggtgcacggtcgccgcgtcgtgtccggtgagctcggtcagccgcttcgccgctcgtcccgtcggcgcggcgaggatcaccttggcctttttcgcctgagctaatgcgatgatcgaccgcacggtgaagctcttgccgcagcctggacctccggtgagcacggcgaccttctcggtcagggccagcttgacggcgcgctcctgcgcctcggcgagttcggcaccggtagcgcggcgcaaccagtcgagggccttgtgccaatcgacgtcggcgaagacgggcatccggtccgcgctggtgttcagcagccgggacagctggttggccagggcgacttcggcgcggtggaagggcacgaggtagatcgcgaccgtcggcacctcgtcgtcatcggtggggatctcctcgcggaccacaccttcctcggtgacgagttcggcgaggcattcgatcaccagcccggtgtcgacggcgaggatcttcaccgcctcggcgatcagctcgttctccggcaggtagcagttgccgtcgccggtggactccgacagcgtgaactgaaggcccgcctttacccgctgcggggagtcgtgcgggattcccaccgctttggcgatggtgtcggcggtcttgaaaccgattccccacacgtcgcctgccagccggtatggctcttccttgacggtccggatcgcgtcgtcgtggtactgcttgtagatcttcaccgccagcgaggtcgagacgccgacgccttgcaggaagatcatcacctccttgatcgccttctgctcctcccacgcgtcggcgatcagcttcgtccgcttcgggccgagcttggggacctcgatcagccgcgcgggttcctgctcgatgacgtcgagcgcggcgacgccgaagtggtcgacgatcttctcggcgagtttggggccgatgcccttgatcaggccagaccccaggtagcggcggataccttgcacggtcgcaggcagcacggtcgtgtagtcgtcgacgtggaactgccgcccgtactgggggtgcgacccccaccggccgcgcatgcgcaacgcctcgccgggctgcgcgcccagcagcgcgccgacgaccgtcaccaggtcaccgccccggccggtgtcgatccgcgcgacggtgtagccgctctcctcgttggcgaacgtgatccgctccagcgtgccctccagcaccgcagtccacgtggccgactcccgtcctttttccaccgacaacacgtatcacgaacggctgtcaagcaaaccggcggtcaccacatgcagcggcatctcccgaacgcctcgggctccggcgtcagcgggtgggcgttcgcgatgccttggtgcggccggtgggagttgtagattttttcgtcctcgcgcagggcctggagtaggtgccgctggctccagatcaggggaaagcgccgggataaaccggcttgacggaggagatggaagagctctacgtcgaatggccagcgacccacgacgaccccgagtcatgcgtcgacgacctgcgaggccgtggcgaagcgttgacagggggcacgtgggggcgtgcgatcaggtcgcggcgccggctcagcgccgtgtccggacgcaccagcagccgcgacggactggttccgctcctcgagcgcggtgtcctcgatcgtctttttcgagctcgatgccggccgcgttcgcgaggtggccagtccagtcggtcggcagtcgtggtcgcagtctgccttttgaacatctggtcaattcagctttgaatgatcgttcggcgagtattgtcctgcccgccaattgtttgctcgccgtgcgccctgggacaggagcgcggcgttcggggacggcgtgctggcgaaggtgtcgattggctcggacggccggaccaggatcgccgacgtcgtgatcgccacgagcgtcggcgatgcccggtactatctggagcaccagcgagtggacaacgacttccacgggcgcggtgcgctcctgatcatgaatcaagaactgagaccgtcagggtgaacgtgccgtcgtggggcactgtgaggatgtgcatcacacggccggggtaggtgatcgaggaggccctgatcgcgggctgccgcggctgtgcccagtcgaatcgcagcaccacctggccgcgggtgagcgtcagcccctgcgcgtcgagtgcgactttgtcggagtccctcaccaccaacgggatctgctcggttgccggtgcgttcgcctgcaccgacctggtgatccggtcgggccgcacggtcacatcggtgacgaccgagccattcgcggtgcggtagcggaaccggtatggctcgccgcccaggaactccgcctgctgcggtccgttcgcgtccggcacctggcccgggaagaccgtcgcccagcaggcgtggtcgttgttgttcatcgactggacgaccgtgcccgcgaccgggtgccacaggaacgtcagaccggtgcggcccagcgaggtcgcgcgcctcgtgccgaagtagccgccgaggtagaactgcggcctgcgtaggaacaggaagtcttgcccctggtcgctgcggatctcggtgaagtgcgcctgttggtatggaagtttcgcgatcgcggccgtgcgctgggcgcgggtcggatagcgctcgccgtagatcgcgtgggtgaggatgcgcggtgaggtgtcctgtttgacgagtgcgggcaccggtgccgggtcctcggcccaggccgctcgtgcggcggcgaggtcttcgcggctggacaggaacgcgcccaagttcggcaccactggcacgaactggttgttcagcgcggtacgttccgggtccggtcgcacgtcggcgtagaaccgcgccgaggtgcgggagttgggggcgacgttggcgaaccagccggagccgtcgggttcgcgcagcaggttgtagctgagccagtcggtgtacttccgcgccatcgtgacgaggttggcgttgttggactggcgccacgcgtcggccatctccggcagcatcacctcgaagttgtagttggtgtccgcgccggtcaactcgtagaagtagcccgaaggactctgcccgttcgcggcaaggcgcgcgaacgcctcggtcaactgctgccgcagcgcggggtcggggtcctggttcagcgcgagcgaggagccggcgagcccggcggtaacctggttcgcgtagtggattgtgggctgccaggcgctaccgttgcccgggttgaggagccacgtcatcgctttgcgcagcgccgaggtgatctgcgactggcgttgcggcaggatgttcgccgcgcgcagcagggcgttggtcttgctcaggtaccccaacccgaagccggtggcggcgagcccgtgctcggtcggcgaatactccggccacgagccgtcatcgtgctgcaaccctaggtagtgtccgagcccggcgtcgagcgcggcgagcagagtcgcgtcgccccggtacgggttccacgtgcgggattgcgtggcgaaccaggcgagcgtgtagacgtgctcctggacgcgggcgttgtaggacaccgccgggctgcgccaccagcctccggcgaagaagccgctcgagtccatgtcggcgaccatcggcgagaccgcggtgaggtacgacgcgaatcgctgctcctcgggtgcgaacaggcgccggttcggtgtggtgggcggcggggcgggcagtgcgagtgcgcgggtcggcagtgcggcgagcagtccgagagcggcggcgccggtcatcaggctgcgacggctgaacgtagtcacgggcctacctccttgtggccgatcaaccctcacccgctgcgtagccgcacgtcaagatgataattcgaattattatgggcttgacgacgcgtaggccgacgacgcagaattcctgccaattcgtattggcaagcgggggtgctcgtggcccgacggctcacccagcaggacatcgcccggatggcaggagtcagccaggccacggtgtcgctggtgctcaacaaccggaaggacggcaacgtccggatcgcggcggagacccgtgcgcaggtactggaggtgattcggaagaccggctacgtcgcgaacccgatcgcccgcaggatgcgcgatcggcacaaccgcatcctcggcgtgttcacctacgaggcggtgttcccgagcacccacgcgaacttctaccagtcgttcctcgaaggcatcgaggaacaggccgaggaggtcggctgtgacctgttgttgttcaccagcgccaaggccaccggggagcggcggcggattttcggcgacgacagccgggtgcggctcgccgacggcagtctgctgctcggtcgcacggtcgaccgcgacgacctgacccagctgctcgccgaaagcatcccgtacgtctccatcggacgacgcgacgacgcgggcggtccggtgccgcacgtcggggccgactaccgcaccgcggtgcgagacctggtggaccgcgcggtcgcgctcggccaccgcgggttcgcgtacgtggggtctggtgggggcgcggagtcgtccgcggatcggctgcgaggcttccgcgaagccgttgccgcacatggcgtccaagggatgcatgtggagaccccacagctcgatcagctgcgcgaagcgggcgtcaccgctgtgctcaccgaagaggtgtcggacggggccgcgctcgtgctcgccgggcgcgaacgcgggctctccgtgccgggcgacctcgccgtgctctcgctcggtgccgctacccggtcggcaccggacgacgacgtggcgctcaccggtttccgcatccccaggcgcgagatggggcgccgggcggtgcaggcgctgaccgaggtgctcgaaaacggcaccacaccgcaagaactgctcccgtgcgagttcgtcgagggctcgacgctgggcgcaccacgcctttgaccaggaggaactgttgctcgaccacaccacggacgttgtcgtcgttggcggcggactcggcggtgtcgccgccgcactcgcgttgctgcgcgcgggccgccgggtcgtgctcaccgaggagtacgactggctcggcggccagctgaccagccaggccgtgccgcccgacgagcacagctgggtggagcgcttcggcgtcaccgcgagctaccgggcgttacgcgacggcatccgcgactactaccgccgccactacccgctgaccccgcgcgcacgggcgtggcgggagctcaaccccggtgcgggcaacgtgagcaggctctgccacgagccccgcgtcgccgtcgcggtgatcgacgagatgctggcgccgttccgcggcagtggcaggctgaccgtgctgcagccgtaccggccggtggccgcgcacaacgacggcgaccggatcgtgtcggtgaccgttgcgcaccgcgacaccggtgaacagatcgagctctccgcgccgtacatcctggacgcgacggagacgggtgaactgcttccgttgtccagcacggagtacgtcaccggcttcgagtccactctggacaccggcgagccgagtgcgcccgacgtcgcgcagccggcgaacatgcaggcggtgtcggtgtgcttcgtggtcgaccacgtcgacggcgaccacaccatcgacaaaccggcgcggtacgacttctggcgcgcgtaccagccggacttctggggcgaccggatgctgtcgttccgctcccccaacccgcgcacgctcgcgatctccgaacgtacgttcaccccgaacccggacgacgacccgctcggcgtcgtgtcggaccagcggctcagtgccggtgacagcaatctgtggacgttccggcgcatcgccgcgcgtcgcaacttcgtcgagggtgcctacgacagcgacatctgcctggtgaactggccgatcatcgactacttcgagtcgccggtgatcgacgtgccggacgccgacgcgcacatcgccgcggcgcgggaactctcacgttcggtgctctactggctacagaccgaggcgccgcgcccagacggcggcaccggcttccccggcctccgcctgcgcggcgacgtcaccggcagcgcggacggtctcgcgcaggcgccgtacatccgcgagtccaggcgcatcagggccgagcacacgatcgtcgaacaggacctctcgctcgccgtgcgcggcgacaagggtgcggtgcagcacgccgacgccgtgggtgtcggcatgtaccgtatcgacctgcacccctccaccggtggcgacaactacatcgacgtcgcgagctgcccgttcgagatcccgctcggcgcgctgatcccgcaacgggtggagaacctgctacccgcgggcaagaacatcggcaccacccacatcaccaacggttcccaccggctgcacccagtcgagtggaacgtcggcgaggtcgcgggcgcgctcgctgccttctgcctggcgcaccgagtcacccctcgcgcggtgcgcaatacccctggcctgctcgcggacttccagcagtgtctggaacgcgacggggtcgagctccgctggccggacgtgtccggctactgacgcagggagacgaaaatgacaaagctgtcacgacgactcacggcactcatcgtcgcagggctgttcgccctcaccggctgcggtggtggatcaaccgcacagtccggaccgaagtcgctgcgcatgaccgtgtggactgccaacgcggcgcatctcaagctgctcaacgacatcgccgccgagtacaaggcctcgcacccggacatcgccgagatcaagttcgactcggtgcccgccgacggctacaccaccacgctcaccacccagatcgccggcggtaacgcgccggacctggcctggatcctggaggagtcggcaccggacttcgtggcgtccggtgcgctcgccccggtgcgcggcaagatcgagaaggccgacgagctcgtgccgtccgcgacgaagctgtgggagaaggacggcgaactgtacgcctacccgttctccacctcgccgttcggcttgttcgtcaacaccgacctggtgaagggcgcctcggcggactggacctgggaccaggcgatcgcggctgcctctgcgtcggcggccgcctccggcaagggcggcctggtactgccggacttcaagtaccagaactgggcagtgctgtcctctatctggcgcggctggggagctgatgcgtggagcgcggacggtcgctcgtgcgggttctccagcagcgagatgaacgacgcgatgtccttcttgcacaaggccatcttcaccgacaaggcgattccgggccccggcacgacggtggacttcttcgccggcgacgcggcgatggcgatcggccagatctcccggtccagtgcgttgaaggacgcgaagttcggctggacgctgctgccgctgccggccggtccgaagggtgactacgcggtgatcgggcaggccgggatcggtgtgctgaagcagtcgcacaacgtcgacgccgcgacggacttcctcgccttcctcaccaaccagaccaactccgccaagctcgcgcagttcttccccccggcgcggtcgtcgctgctcaacgcggagacgctcgccaagagcaacccgttgatcaaggccgagcaactgcagtccgtcgtcgtcgacggcatcaacaagggcgtcgtgaagccgagccacaagggtcaggaggagctgaaccagacgatccgcgccgcgctcgacccgttgtggaagccggacgcgaacgtgcagaacgtgctgaacgacgtgtgcaccaagatcaaaccgctgctggagaacaagtgacggcggtcgcacactccacgcgggccgtagcccgcaaggggacgtcgtactggacgcagcgcaggcgcgacaatctggttggttacctgttcgtcgcgcccgcgctgctcggcagcatcgcgttcgtgctggtgccgctggccttggtcggctggtacagcctcaacgagtggaacgtgctcgccggcacgttcgagttcgtcggcgcgcagaactaccaacagctgctcgccgacgagaagctgcgcgactcgctggtggcgaccacttggttcgccgccggcctggtcgtgctcaacctgtcactagcgctgctgctggccgtgctgctcaaccagaagctgagcggcaccacggtcttccgcacgttgttcttctctcccgtcctcgtgtcgctggtggcgtggacgctggtgtggcagctgatactgcagccggagggcagcgtcaacggactgctcgggttcttcggtgccgacgggccgaactggctgcgcggtgagtcgaccgcgatggtctcggtgatcgtcgtgcaggtgctcaagaacgtcggcctgaacatggtgctgttcctcgcggcgctgcaaggcgtgccgcagccgttgtacgaggcggcgaagatcgacggggcgggtgcctggacccggttccgccgcatcaccttgccgttgatcagcccgacgatcctgctcacgtcgatcatcaccatcgtcggctcgctgcaggtgttcgcgcagatcgcggtgctcacgcagggcggtccgggcacgtccacgaccgtactgatctactacctgtaccagcaggcgttccagttccaccacttcggctacggcgcgacgatctcggtactgctgttcgtcatcgtcgccgcactcaccctgctgcagtggcagatgcgccggaagtgggtgctgcatgaggcttagggtcaagatcacgctatacgggctgctgtgcctgctgtgcgtgcctttcgtgttcccaacctggtggatgatcacctcgtcgatgaagcccatcagcgagatcttctccacctcgccgctgccgtcggagtggacgttctccacctaccggcaggtgttcgagatgcagccgttcgcgcagcagtactggaacagcctctacatcgcggtgatcgtcacgacaggcacaatggcggtggcggcgatggccggatacgcgttcgcgcgtatccggttcccgggccagaacgtgctgttcgtggtcgtcctgatcggcctgctcatcccgagcgaggtcaccatcgtgccgctgttcaagatgttccagtcgctcggcctgaccaacacgcactggccgctaatcatcgtgccgatcttcggggcgccctgtgtgctggcgatcttcatcatgcgccagttcttcatcgccctgccgtcggagctggaggaggccgcgcggatggacggcctcggacgagcgggcatcttctaccgggtggccctgccgctgtcccggcccgcgctgggcgccgtcgcgatcttcacgttcctgcactcgtggaacctctacctggagccgatcgtctatctgtccacaccggacatgtacacgttgccgcaagcgctcacgcagttcgtcgacaactacggcggcccgatgtggaacgtgcagctcgccgccgcgaccatgaccgcagtgccgattctcgtcgtgttcgtgctggcgcagcggcagttcatcgagggactcgcgcacaccggggttaaggggtgagtcccgcgatcgacccggagatcgccgcgctggtagacctcgccagaccaccggtgacgccagcgggaatcgacgcggtccgggcgggaggacgcgtcgtcaccgatgccgagctgacgcgcggtggcaccgtgacgttcgccgatgccgatgccgatggcgtgcccgtgcttgtgctgcgcccagcgggtgtgccacgtcttccggtgctgcacctgcacggcggcgggatggtcgcgggcacccggcgcaccgacctgcacgtgctggccgagtgggtgtcggagctgggtgtcgtgctggtgtcgccggagtaccggctcgcacccgagcacccgcacccggcgccgtcgcaggactgcttccgggtgctggagtggatgtcccgcaacggcttcggcccgcctgtcgttgcgggtacatcggcgggcggcgggctggcggctgcggtgacgctgatggcccgcgacctcggcggtccgccgatcttgccgtcggcgcgcaactgctcgaacgcgtccagcgtctccgccaacggcgtgctaccgcgccagtgcagcaggtagacgtccaggtgatcggtgcccaaccgccgcagactgcgttcgcacgcctcgacggcgccacgccgacccgcgttgtgcggatacaccttgctgaccaggaaaacctcgtcgcggcgcccggcgatcgcggcaccgacgacctcctcggcgcccccgctgccgtacatctcggcggtgtcgatcagccccaggccgaggtccaggccgcgccgcagcgcggcgacctccgccgcgcgctgcccacgccgctcccccatgccccaggtgccctgccccagcaccggcaattcctgcccgccacgcagttgaaggcctcgcatgcacactccgtttcagtcagcgctgctgcggcagcacggccaccagctcgaagccaccgtcctcggacggcccggcggccaaccgcccaccggccatctgcacccgctccgacaggccggccagcccggacccgccgctgccgacctcgatggccggtccccgccggtcgggggcgccgtttgtgacggcgacgtgcagcgagccctcgcggaacaccagccgcaccttgatgtcagcaccgggtgcgtgcttggaagcgttcgtcaacgcctcctggacgacccggtaagccgcgcgctcaaccgcaggcgacaccccgtgcgggtcgcggatctccgaggaaagctccacatccacaccggcggcgcgcgcccgcacgaccagctccgggatcgtgctcaacccggcccgctgcctgggggcgccgagcccgagcgtcgcgcgcatctcgtccagcgcctgcttcgccaacccgcgcagccgcccggcggtctccttcgcaccgggatcctcggtggtggccgccaacgccgccgactcgaccgcgattaaggtcacgtgatgtcccaccgcgtcgtggatctcccgcgcgatccgggcccgctcctccgcgcgcgccgtctcggccttcgcctgcaactccgcctcggtggccgcctccagcttccgcagactgtccgccagctgctcccgcaacgccaccagcgcccccaatgccgtcggcgcgcctgccgccagcagcacgaacgccacggtcaggatgatcgacccgacccccagcgactgcatgatcatcaccggtgccacggcgaccgccgcggtcagcaacacccagccgaccaacatctggatccgcggctgcgcgcgccccaacgcgtacaacgccacgaccgtcggcgcccaacccaaaccaccggccaacgctggcatgcacagcagcaccgcgatccgcggccaccgccgcaacggcagcagcgccgaagccaccaaaccggacaccgtcgcatagccgaacgggtcgggcgcggccagcacagctgccgccggaatcccgacgaccagcgcctcaacgccgagccgagaccagcgcaccgaactcaccggaagccgcccgccacgcgctgcgcgatcaacgcggcctgcacccggttctgcgcgccgagcttgctcaacaccgtcgacacgtagctcttgaccgtcgcctcggtcagcccgagccggaccccgatatcggcgttggaccgaccatccgccaacaactggagcacctgccgctcccgcccggacaacccctgcaccagctgcgtctcgtgcgcgttgtcggacagactgcggaacctgggcaacaaccgcgcagtgatccgcggatccagcaccgccccaccggccgccagatcgtgcaccgcccgaaccagcaccgcgggctccgcgtccttgagcaggaacccgtgcgccccgaaccgcaaggcatcggccacgtaatcgtccaggtcgaacgtcgtcagcaccgccggcaccggcggattcgccaacgtcgccaagtcccgcaacgccgtcagcccgtccttgccgggcatctgcacgtcgatgagggcgacgtcgacgcggtacgcgcgcaccgcggccagcaactcatccccgttgcccgcctcggcgaccacccggatcgagccgtcgccctccaacaacacccgcaggccacgccgcagcatcgcctcgtcatcggcaagcacaacgcggatcggccccccgccgtcgtcagcccgcacctctcggtcacctccctgttccgagggtcgccagcagactagcggggccgcgaaagcgcagcgcacacgccacccgagcgcactgtgtcagcggcgcccgcccttggccttccgctcccgcacccgcaccgagatccgcaccgggctacccacgaacccgaacgtctcccggaacctgcgctccaggaaccgccggtacccggcctccaagaacccggtggtgaacagcacgatcgtcggcggccgcgactgcgcctgggtggcgaacaggatcttcggctgcttgccgccccgcaccggcggcgggttggccgcgaccagctcggaaagccaaccgttcaaccggccggtggagatccgggtgtcccacgaatccagcgccgtgcgcagcgtcggggccagtttcgccaccgcgcgaccggtcttcgccgacacgttgacccgctcggcccaccgcacccgcaccagctcgcggtcgatctccttctccaactggtggcggcggtcctcgtcgaccaggtcccacttgttgtaggcgatcaccaatgcccgaccggcctcgacgaccatagtgatcacccgcaggtcctgctcgctcaacggctcggagccgtcgatgagcacgatcaccacctcggccgcctcgatcgcggccttggtgcgcagcgacgcgtagtactcggtgccgcttgcggtcttcacgcgcttgcgcagcccggcggtgtcgacgaaccgccacacctggccgtccagctccaccagcgagtccaccgggtccaccgtggtgcccgcgacgtcgtgcaccaccgaccgctcttccccggtcagcttgttcagcaggctcgacttgcccacgttcggcttgccgaccaatgccacccgccgcggcccaccggtcgcgccgaagatctcgcgcggcgtctccgggaacacctccaggacggcgtccagcaggtcaccggaaccgcgcccgtgcaacgcgctgaccggcatcggctcgcccaaccccagcgaccacagcgaatgcacgtcggagacgcctcgctggtcgtcgaccttgttggcggccagcagcaccggacgcttggaccgccgcagcaccctggccacggcttcctcggtctcggtggcaccgacccgggcgtccaccacgagcagcaccgcatcggcggtgtgcatggccagttccgcctgcgcggccaccgacgcctgcagtcccttcgcgtccggctcccagccaccggtgtcgaccaccgtgaagcggcgcccgttccacaacgcgtcgtaggccacccgatcccgggtgacaccaggggtgtcctgcacgacggcttcccgacggcccagcagccggttcaccagcgtcgacttgcccacgttgggacggccgaccacggccagcaccggctgcggcttcgtcggctcctcgccctcgaccgcttcgacctcgtcgaactcagcccactcagcctcgtcggaccacgtgccgtccaggccttccaccgactcgtcggtcacgctcgtttccctctcgaatagtcttggctctggtccgcgaccagccgatccagctcggcgatcagctcgaccagttcggtgcgcaccgcctcggtcgccacgaccagcccggcgcggcctttgcccgccggcagcacgatcggctccccgaacaacacgtcgatcctcggtagcagcctacggcccgggccatccgggcggcgcgtgccccggcaggccaccggcaggatcagcgcctccgacgtccgcgccaaccacgccgcaccgtgctgcgcattggtcacatcgccatcaccccgggtgccctccgggaacaccccgacgagaccaccggcccgcagcacccgcaccgccgccagcagcggggcgcggtccggcgcaccgcggcgcaccccgatctgcccgatgcggcgcaggaaccagcccagcgcaccgcggaacatctcctgcttgatcaggaacaccgcgtggcgcgggatcattccgaacagcagcggcccgtccatcatcgaactgtggttggccaccagtaccaccgggcccgtgcgcgggatccgctccgcgccgtggatccgcacccggtacggcagctgcacgatccggcgcgaaatccactggccgcaccggtgcattccaccggacgcgccctcgggcagggtctcgtcgctcatggcgtcgtccgctccgccgcgaccagcaggccacggcactccacgtgcttgcgcaactgcgtgagcacctccaccacacccaggtccgtggtgtcgagctccaccgcgtcgtcggccttgcgcagcggcgccaccttccgccccgagtccagcgcatcgcggcgctgcacgtccgcgtgggtccggtccaggtcaccggcccgtccctcggagacgtcctgcgccgtgcggcgctgcgcgcgggcgtgcgcggacgccgtcaggtagaccttcaaacccgcatccggggccaccacggtgccgatgtcgcgtccctcgacgaccatgccgcctggcgacaccagcgcctcaccgatcagcttccgctggtgggcgaccaactgctcccgcacctcggcgaccgccgacaccgccgacaccgcgccggtcacctccggcccgcggatctcccgccccacgtccgagccgtccaggaagatctcagggccctccggatcggtgcccaccgtcagccgcgctgcgcgcaccacgcctgccactgcggccggatccgacgggtcgacctcggcgcgcagcaccgccagcgtcacggcgcggtacatcgctccggtgtcgaggtaggtagcccccaatgcgaacgccaacttgcgggacaccgtcgacttgccggtgcccgaagggccgtcgagcgccaccacaccaaggagcctggcgtgtgccacgtgcatgtccttcccgagccggaaccgatcggcccgacacccggccggaccaaccgtccattctgcctggtccgctcctgccgatcccaatcgcatccagatccaatccggactgcgggacaaatacgaaagttctacgaataaggtcttgggtgtggatgtaactgtgacccccttgccagggctcggcacgcagcaggacttcaccacccgatccggccaccgcatcggcgtgatcacctaccgggacggccgcttcgagctgatcgtctccgaccacgaagacccagacaaggtggccgcctcggtcgccttgaccacctccgagaccagcacgctggccaacctgctgggcgccccgcagctggtcgcccagctcaacgagcagcacagcgaggtcgccgggatcaccacctggcagctgtccgtcgccccgggctccccctacgccggccgaaccctcggcgacacggagatgcgcacccgcacctccgtgtcgatcgtcgcggtcgtccgggacggcaccgtgcacccctcaccgcggccggacttccagttctccgccggcgacctggtggtggtcgtgggcaccgcgaaggggctacgcgcagccagcgaaatcctggaaaagggctgatccggcccgtcccgaacactttcccggccacctgaccgggacacgcgtcaccaacggcggtccagcgcgtgccgatcccctaacaactccatacgcagggcacacgcgagaggaaacacgttgcaagacacggcgatctccctaatagaactgggtgcggttttcttcggtctgggcatcctcgggagactcgcatggaaaatcggggtgtcaccgatcccgctctacctgatcggcgggctggccttcggcaccggtggcctggtccccctgcacggcatcgaaccgttcacccacctcgcctccgagatcggcgtggtcctgctgttgttgctgttaggcctggaatactccgcgggtgaactcgtcaccggcttacgccgctcctggctggccggtgtcatagacatcgtgctgaacgcggtacccggtgcgctggtggccctgctgctgggttggggtccgctcggcgcgttcacaatggccggcgtcacctacatctcttcctccggcatcatcgcgaaggtgctcggagacctgggtcggctcggcaaccgggaaacgccggtgatcctgtcgatcctggtcttcgaagacctggcgatggccgtctacctgccgatcctgaccgccgtgctggccggggtcagcttcctcggcggactgaccgcggtcggggtgtcgctggtcgtgatcaccctggtgctggtggtcgcgctgcgcttcggcaagtacgtgtccgcgctggtcgacagccccgacccggaggtcttcctgctgcgcctgctgggggcggcgctgctcgtcgcggggatcgcctcggagctgcaggtctcggcggcggtcggctcgttcctgctgggcatcgcgatctccgggtcgaccgcggcgaacgcgacccgcatgctggagccgctgcgcgacctgttcgccgcgctgttcttcgtcgtgttcggcctcaacaccgatccgagccagatcccgccggtgctgccggtggcgctgctgctggcggtggcgacctgcgcgacgaaagtgctcaccggctggttcgccgcccggatgcagggtgtcggccggatgggtcggctgcgggccggtgccgcgctggtggcgcgcggcgaattctccatcgtgatcgccgggctggccgtcgcctccggcgcggtgccgggcgagctcgccgccctcgccaccgcctacgtgctgctgatggcgatcgtcggcccggtcgcggcccgcgtcgtcgagccggtggcccggatgttcctccccagccaggcgaagaaggcctgaccggaaaagcctccggctgtcccgagcggacgggccggaggctttctcaacgctgcggataacgcgggcgggtctggcaaacgcaacaccggtgcgcgaacagcctcagaggcccactgcgcggtagagcgagccgatctcctggcggttcaacggccggatcgcgcccgggcgctcgttggtcagccgcacatcgccgatccgcgtccgcaccaggcgctgcaccgggtagccgacgtgcttgagcagccgccgcacgatgcggttgcggccctcgtgcaacacgatctccaccagcgaccggttctggttcatgtcgaccagcttgaaccggtccaccttcaccagaccgtcctccagctccacgccctcgcgcagctgctgcccgaggtccttcgggatcgaccccagcacctccgccaggtacgtcttgcgcaccttgtacgacgggtgcatcagccggttcgccagctcgccgtcgttggtgatcagcagcaggccctcggtgtcctggtccagccgccccacgtggaacagcttgccctcccgttcccgcaggtaatcaccgatgcacggacgccccttgtcgtccgacatggtgcacaggatgccgcgcggcttgttcagcagcaggtgcgtcagatcgtcgttgaccatcacccggttgccgtccacgtggaccaccgcggtcgtcgggtcgacccggcgccccagctcggtgacgacctcgccgtcgacctcgatccgcccctcgacgatcatctcctcggccgcgcgccgcgaggccaccccggcctgggacaacactttctgcagccgcacgccttccgaatcggcagtgctgctgtacggggaacggtgctcagacgtcatcaatcgaatccacttcgggcaacaagggggcgagcggcggcaactccttcaacgacgacagccccagccgctccaggaacagctcggtcgtgcagtacaggatgccgcccgtctccgggtcggttccggcctcttcgataaggccgcgccccaccagggtacggatgacgccgtcgacgttcacaccccgtactgccgcgacccgcgaacgcgtcaccggctgccggtacgcgatcaccgcgagggtctccagcgcggcacgcgtcagcttcgaacgctgcccgtccaacaggtaccgctccacgtacggggcgtacttctcccgcgtgtagaaccgccagccgtcgccgacccgccgcaggtcaacgccccgttccgcctcggcgtagccgtccgagagccgccgcagcgcggaccggatccgggccaccggctgctccagggtgtcggccagcagctcctcgccggccggcacgtcgaccacgagcagcaacgcctccagcgccgcatccagcgccgaatcggaggtcaggtccggcgcactcggcgcctccaccgcctcggaatccccagcggccgccgacggctccaacggttcctgcggctcagcgggcggcggggtcggcgactcctccgcgacctcgcccgcggcctccggctccagctccgtcacccgtactcctcttcttcatggctggcgcgctgcgcctcggcttcggcctccgcctgcgccacgctgccgcccacccagctcacgatcagctcacccagcggggtctcctgctcgaacagcaggaccttctcccggtagagctcgagcagcgccaggaaccgcgccaccacctcgacggtgtgcccgcagtccgacaccagctccgagaacgtcgcgctgcccttctccgccaaccgcacccgcagcagcgccgcgtgctcgcgcaccgaaacgccgtgctggtggatgtggtccagcgaaacggtcggcggtggcttcggccggaacaccgcggccgcgatctcggcgaaccgctgcggcggaaccccgatcaccacttccggcagcaggttcgcgaaccgctcctcgaccgacaccgaacgcggatagcgccgcagcgccccggcctccaactcgccgaacagcgcggccacctgcttgtacgcgcggtactgcagcagccgcgcgaagagcaggtcgcgggcctccagcagcgccaggtccgcctcgtcctcgacctccgcggccggcagcagccgggccgccttcaggtctaacagcgtcgcggcgaccaccaggaactcggtggtttcgttcaggtcccaccgctcgccgagcgccttggtgtaggcgatgaactcgtcggtgaccttgtgcagcgctacttcggtaacgtccagctggtgctgcgagatcagctgcagcagcaggtcgaaggggccctcgaagttgtccagccgcaccgtgaaccggccgcctgcggcgggatcctcgctcgactgcgccgccggtaccgcggggtctgtcactctccgggctcctgcaggcgccgcaccagcaccgagtccgcgccgttcttgtcgaggtcggcgagcaccacggcaaccgcttcgcgcaccacgcggcctcggtccacggcgatgccgtggtcggcccgcaatgccagccgcgcctgctccaagcccagcaactcctcgtcggacacgtacacggtgatcttcgaatcgtgcttgcgccgtccagagccgccccggcccgccgcgggtgccgcctgctccgggtccggcggattcgcgtgatccgtccgaggaacagtagtacggaacaattcggccgctccgggcagggcgacccgacgcgtcatcgggcgatcacctcgcgcgccagtgcgcggtacgcctgcgccccggccgagcggggcgcccagcgggtgatcggctcgccggccaccgtggtctccggaaaccgcaccgtgcggttgatcaccgcatcgaagacgatgtcgccgaacgcctcgacgacgcgcgccatcacctcgcgcgagtgcagcgtgcgcgggtcgaacatggtcgccaggatgccgctgatctccagcctcgggttcagccgctcccgcaccttctcgatggtgtcgatcagcagcgccaccccgcgcaggctgaagaactcgcactccagcgggattatcacggcgtccgcggcggccaacgcgttcaccgtcagcagccccagcgacggctggcagtccaccagcacgtagtcgtactccgccagcgccggctgcagcacccggtgcagcgtctgctcccggcccacctccgcgaccagctgcacctcggccgcggacaggtcgatgttgctgggcagcaggtccatgccctcgacggtggtctgccgcaccacgtcatggatggcgaccggccgttccatgatcacgttgtagatggtctggtcgagctggtgcggctggaccccgaggccgaccgagagcgcgccctgcggatcgaaatccaccagcagcacccggcgcccgtattccgccagcgctgcgccgaggttgatcgtcgacgtggtcttcccgacgccgcccttctggttgcacatcgcgagcaccgatgcgggaccgtgccggtccagcagcggcggctcggggatgtgccgacgtggccggccagtgggaccgaggccgcgggggttcggcgccaggccgacctcctcctcgcggcccgccgtctcccgggcgatgctcaggtcgaccgcgccccgggaccgcccttcggcggcgggctgcggcagcgacatggcgatctgactccttttggtgccggtggcgatcaaacgcagcctaagtggcattcgttaccagcggcaacgcgcctcgccgtggtgtcggaagttccctgtgatctgcgtgtgatcaacgtctaccgcgtacaccaccccctcgcattcgcagcgtcaccaagtcactccgtagcgtgtgcgcgcggatgcgtcgtcgcgtagacctcccgcagcgtgttcaccgtgatcaaggtgtagacctgggtcgtcgtgaccgaggcgtggcccagcagttcctgcaccacgcggacatccgcgccgccctccacaaggtgcgtggcgaacgaatgccgcagcacgtgcggcgaaaccgagccgttgatcccggcgcgctgcgcggcggtcttcaacgcgttccacgagctctgccgggaaagccgggtaccgcgcgaattcaggaacaccgcggcactaccccgcccgcgcgcggccaggccgggcctggcccgtaccaggtacgcgtccagcgccgccagcgccggtcggccgatgggcaccagccgctggcggccgcccttcccttccagcagcacggtccggttggtgccgtcgatgtcgtcgaggtccaacccgaccgcttcggagatccgcgctcccgtcgaatacagcacttccagcagcgcccggtcccgcaggccccgggcatcctcgcccccggcgtgatcgagcagcttcccgacgtcgccgatggaaagcgccttcggcagccgcttcggcgggctcggcggcgcgacatcgcgcgctacgtcgaccggcagcagcccctcggcgtgcgcgaagcggtgcaggccgcgggcggccaccaaagctcgggccgacgacgacggcgccagcgcgggccgctgcccggtgccttcccggagctccgccaagaacccggacaggtgctccgaacgcacctcgccgagcccagaaatccctgccgcgaccaggaattcggcataccggcgcaggtccctggcgtaggagtcgagagtgctgcgggcggtaccgcgctcgacggcaaggtggtcgaggtacccggtgatcgccccgcgcaggtccggcggcagctcctcgaaacccctcaccgggcggcgaagcgctggggccggtccggccattcggcatccgccgggcgaggctccacccggccctcgcggaccgcgtgggcggcgagcagccccgccaccccggggccgttgacgatctccccggccagcgccatccgcaccgcctcggcgagcgggaagcggcggatc

SEQ ID NO: 7 - DNA, 828 bp, Saccharopolyspora spinosa
  CDS (1)..(825): ORF1; O-methyltransferase
gtgttgccaggtggcgcaccaacatcgcagcaggttgggcagatgtatgacctggtcacgccgttgctgaactcggtcgcgggcggcccctgcgccatccaccacggctactgggagaacgacgggcgggcttcctggcagcaggccgccgaccggctcaccgaccttgtcgccgaacggaccgtgctcgatggcggcgttcgactgctcgatgtggggtgcggtaccggacaaccagcgctgcgcgtcgcgcgcgacaacgcgatccagatcaccggcatcaccgtcagccaggtgcaagtggccatcgccgctgattgcgcacgcgaacgcggactaagccaccgggtggacttctcgtgcgtcgatgccatgtccctgccgtacccggacaatgctttcgacgccgcctgggccatgcagtcgctgttggagatgtccgaaccggaccgtgccatccgggaaatccttcgagtactcaaacccggtggcatcctcggcgtcaccgaggtcgtcaaacgagaagcgggcggcgggatgccggtgtccggggacaggtggccgaccggccttcggatctgcctggctgagcaacttctggaatcgctgcgtgcagcggggttcgagatcctcgattgggaggacgtgtcgtcgaggacccggtacttcatgccgcagttcgccgaagagctcgctgcgcaccagcacgggatcgcggacaggtacgggccggctgtcgccggctgggccgccgcggtctgcgattatgagaaatatgcccacgacatgggctatgcgattctgacggcgcggaagccggtcggctga

SEQ ID NO: 8 - protein, 275 aa, Saccharopolyspora spinosa
VLPGGAPTSQQVGQMYDLVTPLLNSVAGGPCAIHHGYWENDGRASWQQAADRLTDLVAERTVLDGGVRLLDVGCGTGQPALRVARDNAIQITGITVSQVQVAIAADCARERGLSHRVDFSCVDAMSLPYPDNAFDAAWAMQSLLEMSEPDRAIREILRVLKPGGILGVTEVVKREAGGGMPVSGDRWPTGLRICLAEQLLESLRAAGFEILDWEDVSSRTRYFMPQFAEELAAHQHGIADRYGPAVAGWAAAVCDYEKYAHDMGYAILTARKPVG

SEQ ID NO: 9 - DNA, 1173 bp, Saccharopolyspora spinosa
  CDS (1)..(1170): ORF2; glycosyltransferase
atgcgcgtactcgtcgttcccttgccctatccgacgcatctcatggcaatggtgccgctgtgctgggcgctgcaagcatccgggcacgaggtcctgatcgccgcaccaccagagctgcaggcgaccgcgcatggtgcaggtctcaccacggccgggatccgcgggaacgacaggaccggcgatacgggtggaaccacgcagctgcgctttcccaatccggcgttcggtcagcgcgacaccgaggcaggccggcaactgtgggagcagaccgcgtccaatgtcgcgcaaagctcgctcgatcagctccccgaataccttcgactggccgaggcctggcgaccgtcagtgctgttggtcgacgtctgcgcgctgatcggccgggtgctcggcggattgctcgacctgccggtcgtgctgcaccgctggggagtcgaccccaccgcaggccccttcagcgatcgagcccacgagttgcttgacccggtgtgccggcaccacggactgaccggcctgcccactcccgagctcatcctcgatccctgtccgccgagcctgcaagcaagcgacgcgccgcaaggcgcaccggtccagtacgtgccgtacaacggaagcggcgcattcccggcatggggcgcggcgcgcacctcagcacggcgggtctgcatctgcatgggccgcatggtgctgaacgccaccgggccggctccgctgctgcgcgcagtagcggctgccaccgagttgcccggcgtcgaggccgtgatcgccgttccccccgagcaccgggcacttctcaccgacctacccgacaacgcccggatcgccgaatcggtcccgctcaacctgttcctgcgtacctgcgagctggtcatctgcgcgggcggctcgggaacggcattcaccgcgacccgactcggcatcccgcaactcgtgcttccccagtacttcgaccagttcgactacgcgcgcaacctcgccgctgccggggcgggcatctgcttgccggatgagcaggcccagtccgaccacgaacagttcaccgactcaatcgcaacggtgctcggcgacaccggcttcgctgctgcggcaatcaaactcagcgacgagatcacggccatgccccatcccgccgcgctggtgcggacgctggagaacactgcggccatccgtgcctga

SEQ ID NO: 10 - protein, 390 aa, Saccharopolyspora spinosa
MRVLVVPLPYPTHLMAMVPLCWALQASGHEVLIAAPPELQATAHGAGLTTAGIRGNDRTGDTGGTTQLRFPNPAFGQRDTEAGRQLWEQTASNVAQSSLDQLPEYLRLAEAWRPSVLLVDVCALIGRVLGGLLDLPVVLHRWGVDPTAGPFSDRAHELLDPVCRHHGLTGLPTPELILDPCPPSLQASDAPQGAPVQYVPYNGSGAFPAWGAARTSARRVCICMGRMVLNATGPAPLLRAVAAATELPGVEAVIAVPPEHRALLTDLPDNARIAESVPLNLFLRTCELVICAGGSGTAFTATRLGIPQLVLPQYFDQFDYARNLAAAGAGICLPDEQAQSDHEQFTDSIATVLGDTGFAAAAIKLSDEITAMPHPAALVRTLENTAAIRA

SEQ ID NO: 11 - DNA, 753 bp, Saccharopolyspora spinosa
  CDS (1)..(750): ORF3; O-methyltransferase
atgccctcccagaacgcgctgtacctggacctgctcaagaaggtactcaccaacacgatttacagtgatcggccgcatccgaacgcctggcaggacaacaccgactacaggcaggccgctcgggccaaaggcacggactggccaactgtcgcgcacacgatgatcggtctggagcggctggacaacctccagcactgcgtggaagccgtgctcgcagacggtgttcccggggatttcgccgagaccggtgtctggcggggcggcgcatgcatcttcatgcgcgcggttctccaggcattcggagataccggacgtaccgtctgggtagtggattccttccagggaatgccggaaagctctgcgcaagaccaccaagcggaccaggctatggcgctgcacgagtacaacgacgtgcttggcgtatcgcttgagaccgtccggcagaacttcgcccgctacgggctgctcgacgaacaggtcaggttcctccccggctggttccgggacaccttgcccaccgcccccatccaggaactcgccgtgctacgactcgacggcgacctctacgaatccacaatggactcattgcggaacctgtacccgaagctctcgccgggcggattcgtcatcatcgacgactattttctgccgtcctgccaggacgcggtgaaggggttccgcgcggaactcgggatcacggaacccatccacgacatcgacggcacgggcgcctactggcgccgcagctggtga

SEQ ID NO: 12 - protein, 250 aa, Saccharopolyspora spinosa
MPSQNALYLDLLKKVLTNTIYSDRPHPNAWQDNTDYRQAARAKGTDWPTVAHTMIGLERLDNLQHCVEAVLADGVPGDFAETGVWRGGACIFMRAVLQAFGDTGRTVWVVDSFQGMPESSAQDHQADQAMALHEYNDVLGVSLETVRQNFARYGLLDEQVRFLPGWFRDTLPTAPIQELAVLRLDGDLYESTMDSLRNLYPKLSPGGFVIIDDYFLPSCQDAVKGFRAELGITEPIHDIDGTGAYWRRSW

SEQ ID NO: 13 - DNA, 1188 bp, Saccharopolyspora spinosa
  CDS (1)..(1185): ORF4; O-methyltransferase
atgagtgagatcgcagttgccccctggtcggtggtggagcgtttgctgctcgcggcgggtgcgggcccggcgaagctccaggaagcagtgcaggtggccggactggacgcggtggccgacgccatcgtcgacgaactcgtcgtacgctgcgatccgctgtcgttggacgagtcggtgcgaatcggcctggagatcacttctggcgctcagctggtccggagaaccgttgagctcgatcacgcaggcctgcggctcgcggcggtcgccgaagcagctgctgttctccggttcgacgcggtggatctgctggaagggctcttcggcccggttgacggcaggcggcacaacagccgtgaagtccgctggtcggacagcatgacgcagttctcgcccgaccagggcctcgccggcgcgcagcgcctgctggcgttccggaacagggtgtccaccgcggtgcacgccgtgctggccgcagccgccaccaggcgcgcggacctcggtgcgctggcagtccgctacggatccgacaaatgggcggacctgcactggtacaccgaacactacgagcaccacttctcccgattccaggatgccccggtgcgagtgttggaaataggaatcggtggttatcacgcacccgaactcggtggtgcttcgctgcgcatgtggcagcggtacttccggcgaggtctcgtttacgggctggacattttcgagaaagccgggaacgaagggcaccgagtgcgaaagctgcgaggtgaccagagcgatgcggaattcctggaagacatggcggggaagatcgggccgttcgacattgtcatcgacgacggcagccatgtcaacgaccacgtcaagaaatccttccaatccctgtttccgcacgtccgcccaggtggtttgtacgtcatcgaggatctccagacggcgtactggcccggctacggcggtcgcgatggggaacccgcggcccagcgcacctcgatcgacatgctcaaagaactgatcgacggcctgcattatcaggagcgcgaatcgcggtgcgggaccgagccctcctacacggaacggaacgtggcggccctgcacttctaccacaacctggtattcgtggagaaagggctcaacgctgagcctgccgcgccggggttcgtgccccggcaagcgctcggcgtcgaggacggctga

SEQ ID NO: 14 - protein, 395 aa, Saccharopolyspora spinosa
MSEIAVAPWSVVERLLLAAGAGPAKLQEAVQVAGLDAVADAIVDELVVRCDPLSLDESVRIGLEITSGAQLVRRTVELDHAGLRLAAVAEAAAVLRFDAVDLLEGLFGPVDGRRHNSREVRWSDSMTQFSPDQGLAGAQRLLAFRNRVSTAVHAVLAAAATRRADLGALAVRYGSDKWADLHWYTEHYEHHFSRFQDAPVRVLEIGIGGYHAPELGGASLRMWQRYFRRGLVYGLDIFEKAGNEGHRVRKLRGDQSDAEFLEDMAGKIGPFDIVIDDGSHVNDHVKKSFQSLFPHVRPGGLYVIEDLQTAYWPGYGGRDGEPAAQRTSIDMLKELIDGLHYQERESRCGTEPSYTERNVAALHFYHNLVFVEKGLNAEPAAPGFVPRQALGVEDG

SEQ ID NO: 15 - DNA, 1620 bp, Saccharopolyspora spinosa
  CDS (1)..(1617): ORF5; C-C linking enzyme, cyclization enzyme
atgatctcggctgcgggcgaacaaagtggaccagtcagaaaaggaggggcggtgcccgaattccatgacccggcacccatgaatcgtcgaaccccaggaacagagatcaccgtcgagcccgacgatcctcgttatccggacctcgtcgtcgggcacaacccccgtttcaccggaaaacccgaacgcatccacatcgccagctccgccgaagacgtcgtgcacgccgtcgccgacgccgtgcgcaccggcaggcgggtaggggtccgcagcggcgggcactgcttcgagaatctcgttgcggacccggcgatccgagtgctcgtcgacctctccgagctcaaccgcgtgtactacgacagcacgcgcggggcattcgcgatcgaggcgggcgccgccctcgggcaggtgtaccgaaccctgttcaagaactggggcgtgacgatcccgaccggcgcatgtcccggggtgggcgcaggcgggcacatcctcggcgggggatacggcccgctgtcgcgccgattcggttcggtcgtcgactaccttcaaggcgtcgaggtcgtcgtggtcgaccaggccggtgaagtgcacatcgtcgaggccgaccggaactccacgggcgccggtcacgacttgtggtgggcgcacaccggtggcggtggcggcaacttcgggatcgtcaccaggttttggctccgaacgccggacgtggtcagcaccgacgccgcagagctcctgccacggccgcccgcgacagtgctgctccgatcgttccactggccgtggcacgaactgacagagcagtcattcgccgtgctcctacagaacttcggcaattggtacgagcagcacagcgcgcctgaatccacgcaactcgggttgttcagcacgctcgtctgcgcacaccggcaagctggctacgtcacgctgaacgttcacctggacggcacggatccgaacgcggaacgcaccctggccgaacacctgtcggcgatcaacgcccaggtcggcgtgactccagccgaagggctgcgggaaaccctgccgtggttgcgatcgacccaggtggccggggcgatcgccgaaggcggcgaaccgggcatgcaacggaccaaggtcaaagccgcctacttgcgcaccgggctgtccgaagctcaactagccacggtttaccggcggctgaccgtctacggatacgacaaccctgcggcggcgctgttgctgctcggttacggcggtatggcgaatgccgtggctccgtcggccaccgcactcgctcagcgcgactcggttctcaaagcgctgttcgtcacgaactggtcggagcccgccgaggacgagcggcatctgacctggattcgcggtttctaccgcgagatgtacgccgaaaccggcggagttccggtgccaggtacccgtgtcgacggctcctacatcaactacccggacaccgacttggccgatccattgtggaacacctccggtgttgcctggcacgacctgtactacaaagacaactacccgcggctgcagcgggccaaagcgcggtgggatccgcagaacatcttccagcacggcctgtcgatcaaaccgccggcacggctttcacccggtcagccatga

SEQ ID NO: 16 - protein, 539 aa, Saccharopolyspora spinosa
MISAAGEQSGPVRKGGAVPEFHDPAPMNRRTPGTEITVEPDDPRYPDLVVGHNPRFTGKPERIHIASSAEDVVHAVADAVRTGRRVGVRSGGHCFENLVADPAIRVLVDLSELNRVYYDSTRGAFAIEAGAALGQVYRTLFKNWGVTIPTGACPGVGAGGHILGGGYGPLSRRFGSVVDYLQGVEVVVVDQAGEVHIVEADRNSTGAGHDLWWAHTGGGGGNFGIVTRFWLRTPDVVSTDAAELLPRPPATVLLRSFHWPWHELTEQSFAVLLQNFGNWYEQHSAPESTQLGLFSTLVCAHRQAGYVTLNVHLDGTDPNAERTLAEHLSAINAQVGVTPAEGLRETLPWLRSTQVAGAIAEGGEPGMQRTKVKAAYLRTGLSEAQLATVYRRLTVYGYDNPAAALLLLGYGGMANAVAPSATALAQRDSVLKALFVTNWSEPAEDERHLTWIRGFYREMYAETGGVPVPGTRVDGSYINYPDTDLADPLWNTSGVAWHDLYYKDNYPRLQRAKARWDPQNIFQHGLSIKPPARLSPGQP

SEQ ID NO: 17 - DNA, 1194 bp, Saccharopolyspora spinosa
  CDS (1)..(1191): ORF6; methyltransferase
atgtccacaacgcacgagatcgaaaccgtggaacgcatcatcctcgccgccggatccagtgcggcgagcctggccgacctgaccaccgaactcggactcgccaggatcgcacccgtgctgatcgacgagatcctcttccgcgcggaaccggcccccgacatcgaacggaccgaggtcgcggtccagatcacccaccgaggcgagaccgttgacttcgtcctgacgctacagtccggtgagctgatcaaggccgagcaacgaccggtcggagacgtcccgctgcggatcggttacgagctcaccgatctcatcgccgagttgttcggcccaggagctcccagggccgtcggcgcccggagcaccaacttcctccgaaccaccacatccggttcgatacccggtccgtcggaactgtccgatggcttccaggccatctccgcagtggtcgccggctgcgggcaccgacgtcccgacctcaacttgctcgcctcccactaccgcacggacaagtggggcggcctgcactggttcaccccgctatacgagcgacacctcggcgagttccgtgatcgcccggtgcgcatcctggagatcggtgtcggtggctacaacttcgacggtggcggcggcgaatccctgaagatgtggaagcgctacttccaccgcggcctcgtgttcgggatggacgttttcgacaagtccttcctcgaccagcagaggctctgcaccgtccgcgccgaccagagcaagcccgaggagctggccgccgttgacgacaagtacggaccgttcgacatcatcatcgacgatggcagccacatcaacggacacgtgcgcacatccctggaaacgctgttcccccggttgcgcagcggtggcgtatacgtgatcgaggatctgtggacgacctatgctcccggattcggcgggcaggcgcagtgcccggccgcacccggcaccacggtcagcctgctcaagaacctgttggaaggcgttcagcacgaggagcagccgcatgcgggctcgtacgagccgagctacctggaacgcaatttggtcggcctccacacctaccacaacatcgcgttcctggagaaaggcgtcaacgccgaaggcggcgttcctgcttgggtgccaaggagtctggacgacatattgcacctggccgacgtgaacagcgcggaggacgagtga

SEQ ID NO: 18 - protein, 397 aa, Saccharopolyspora spinosa
MSTTHEIETVERIILAAGSSAASLADLTTELGLARIAPVLIDEILFRAEPAPDIERTEVAVQITHRGETVDFVLTLQSGELIKAEQRPVGDVPLRIGYELTDLIAELFGPGAPRAVGARSTNFLRTTTSGSIPGPSELSDGFQAISAVVAGCGHRRPDLNLLASHYRTDKWGGLHWFTPLYERHLGEFRDRPVRILEIGVGGYNFDGGGGESLKMWKRYFHRGLVFGMDVFDKSFLDQQRLCTVRADQSKPEELAAVDDKYGPFDIIIDDGSHINGHVRTSLETLFPRLRSGGVYVIEDLWTTYAPGFGGQAQCPAAPGTTVSLLKNLLEGVQHEEQPHAGSYEPSYLERNLVGLHTYHNIAFLEKGVNAEGGVPAWVPRSLDDILHLADVNSAEDE

SEQ ID NO: 19 - DNA, 900 bp, Saccharopolyspora spinosa
  CDS (1)..(897): ORF7; O-methyltransferase
gtgaacagcagaggggcgaacacacaggcatttccgaccgcggatcaggtggagtccatcttcgatgcgttggcgcacgggcgtcccctgcaccacggttactgggcgggcgggtatcgggaggatgccggtgccacaccgtggtcggatgctgccgaccaactgaccgacctgttcatcgacaaggccgcgctccgtcccggagcgcacctgttcgacctgggctgcggcaatgggcagcccgtagtccgtgcggcatgcgccagcggcgttcgagtcaccggaatcaccgtgaacgcccagcatctcgccgccgccaccaggctcgccaacgagaccggactggccggcagtcttgagttcgatctagtcgacggcgcccagctgccctacccggacggtttctttcaggccgcatgggcgatgcagtccgtcgtgcagatcgtggaccaggccgccgcgatccgcgaggtccaccgaatcctggaacccggcggccggttcgtcctcggagacatcatcactcgggttcgactcccggaagagtacgcggcggtttggacgggcacgaccgcccataccttgaacagcttcacggcgctggtcagcgaagccgggttcgagattctcgaagtcaccgacctcacggcacagaccaggtgcatggtctcctggtacgtcgacgagttgctccggaaactcgatgagctcgccggcgtcgagcctgcggctgtcggcacctaccagcaacgctacttgggagacatcgcggcgaagcacggaccgggaccagcacagctgatcgccgcggttgcggaataccggaaacatccggattacgccagaaacgaggaaagcatgggtttcatgctcctgcaggctcgaaagaagcagtcctga

SEQ ID NO: 20 - protein, 299 aa, Saccharopolyspora spinosa
VNSRGANTQAFPTADQVESIFDALAHGRPLHHGYWAGGYREDAGATPWSDAADQLTDLFIDKAALRPGAHLFDLGCGNGQPVVRAACASGVRVTGITVNAQHLAAATRLANETGLAGSLEFDLVDGAQLPYPDGFFQAAWAMQSVVQIVDQAAAIREVHRILEPGGRFVLGDIITRVRLPEEYAAVWTGTTAHTLNSFTALVSEAGFEILEVTDLTAQTRCMVSWYVDELLRKLDELAGVEPAAVGTYQQRYLGDIAAKHGPGPAQLIAAVAEYRKHPDYARNEESMGFMLLQARKKQS

SEQ ID NO: 21 - DNA, 1167 bp, Saccharopolyspora spinosa
  CDS (1)..(1164): ORF8; cyclization enzyme
atggcctccgagcacgccagcctggtcggcgacgatctgcgggcacccgcggatgatcccttctaccgaccgccgacgccgctaccgccgggtgtcccgggcacgctcctcagggcccggcccgtctcggcactgcgcggcacgggcgaacccgtcgcagccaaggcctggcaaatcctctaccggtccaactccgcccttggcatgccgaacgccgtctccggcaccgttctggtgccgaacatcccgtggccgcgcgaagatcgccccatcatcactttcgcagtgggcacccacggcctcggtagccaagttgccccgtcgtacctgcttcgaaccggaaccgagccggagaccgagctgatcgccgtggccctcgaccgcgggtgggccgtggtcatcaccgactacgaaggcctcggtactcctggaacccacacctacaccgtcggcagggcgcagggacacgccatgctcgatgccgcccgcgctgcgcaacggctaccgggctccggcctgacgaccgactgcccggtcggcatctggggctatgcgcagggtgggcaagcgtcggccttcgccggcgaactgcaccccacctacgcacctgaactgcgaatccgcgctgcggccgcaggtgcggtgccgatcgatctgctggacatcatccaccgaaatgacggggtgttcaccgggccggtgctggccggcctggtcgggcatgccgctgcctaccccgatctgccattcgacgagcttctcaccgaagcgggtcgtaccgccgttgatcaagtgcgcgagctcggtgcaccggagctcgtcacccgcttcctcggccgcgagctgagcgacttcctcgacacttccggccttttcgagcaacctcgatggcgcgcacgactggccgaaagcgtcgcaggtaggaacggtggcccggtggtccccacgctcgtctaccacagcacggacgacgagatcgttccgttcgcattcggcgagcgactccgggacagctaccgcgcggcgggtacgccagtgcggtggcatccgctctccggattggctcactttcccgccgccctggccagctcgcgagtggtcgtctcgtggttcgacgagcacttctccgagccgtccgcgatcagcggtccgcgagatgccaggtga

SEQ ID NO: 22 - protein, 388 aa, Saccharopolyspora spinosa
MASEHASLVGDDLRAPADDPFYRPPTPLPPGVPGTLLRARPVSALRGTGEPVAAKAWQILYRSNSALGMPNAVSGTVLVPNIPWPREDRPIITFAVGTHGLGSQVAPSYLLRTGTEPETELIAVALDRGWAVVITDYEGLGTPGTHTYTVGRAQGHAMLDAARAAQRLPGSGLTTDCPVGIWGYAQGGQASAFAGELHPTYAPELRIRAAAAGAVPIDLLDIIHRNDGVFTGPVLAGLVGHAAAYPDLPFDELLTEAGRTAVDQVRELGAPELVTRFLGRELSDFLDTSGLFEQPRWRARLAESVAGRNGGPVVPTLVYHSTDDEIVPFAFGERLRDSYRAAGTPVRWHPLSGLAHFPAALASSRVVVSWFDEHFSEPSAISGPRDAR

SEQ ID NO: 23 - DNA, 1011 bp, Saccharopolyspora spinosa
  CDS (1)..(1008): ORF9; 2,3-reductase
atgaccagctcgatgcgaaagccggtgcgcatcggtgtgctcgggtgcgcttccttcgcgtggcgacggatgctgcccgcgatgtgcgacgtggccgaaacagaggtggtggcggtggcgagccgtgatccggcgaaagccgaacggttcgcagcgcgattcgaatgcgaggcggtgctgggttaccagcggctcctggagcggccggacatcgatgccgtctacgtgccgttgccgcctggcatgcatgcagagtggatcggcaaggcgcttgaggcagacaaacacgtgcttgcggagaaaccgctgacgacgacggcgtccgacaccgctcgcctggtcgggctggccaggaggaagaacctgctgctgcgggagaattacctgttcctccaccacggccggcacgacgtggtccgcgacctgctgcaatccggggagatcggtgagctccgggagttcaccgccgtgttcggaattccgccgcttcccgacacggacatccgctatcgcaccgaactcggtggcggagcgttgctggacatcggtgtctatcccgcccgtgccgctcggcactttctcctcggtccgctcacggttctcggcgcaagctcgcacgaggcccaggagtcgggcgtcgacttgtcgggcagcgtgctgctccaatcggaaggtggcaccgttgcccacctcggatacggtttcgtgcaccactaccgcagcgcgtacgagctgtgggggagtcgtgggcgaatcgtcgtcgaccgggcgttcacgccgcccgccgagtggcaggccgtgatccgaatcgagcggaagggcgttgtcgacgagttgtccttgccagcggaagatcaggttcgcaaggcggtcaccgccttcgcacgcgacatcagagcagggacaggcgtggacgaccctgcggtggccggagattcgggcgaatcgatgatccagcaggccgcgctggtggaggcgatcggtcaggcccgtcggtgcgggtccacatag

SEQ ID NO: 24 - protein, 336 aa, Saccharopolyspora spinosa
MTSSMRKPVRIGVLGCASFAWRRMLPAMCDVAETEVVAVASRDPAKAERFAARFECEAVLGYQRLLERPDIDAVYVPLPPGMHAEWIGKALEADKHVLAEKPLTTTASDTARLVGLARRKNLLLRENYLFLHHGRHDVVRDLLQSGEIGELREFTAVFGIPPLPDTDIRYRTELGGGALLDIGVYPARAARHFLLGPLTVLGASSHEAQESGVDLSGSVLLQSEGGTVAHLGYGFVHHYRSAYELWGSRGRIVVDRAFTPPAEWQAVIRIERKGVVDELSLPAEDQVRKAVTAFARDIRAGTGVDDPAVAGDSGESMIQQAALVEAIGQARRCGST

SEQ ID NO: 25 - DNA, 1461 bp, Saccharopolyspora spinosa
  CDS (1)..(1458): ORF10; 2,3-dehydratase
atgagcagttctgtcgaagctgaggcaagtgctgctgcgccgctcggcagcaacaacacgcggcggttcgtcgactctgcgctgagcgcttgcaatggcatgattccgaccacggagttccactgctggctcgccgatcggctgggcgagaacagcttcgagaccaatcgcatcccgttcgaccgcctgtcgaaatggaaattcgatgccagcacggagaacctggttcatgccgacggtaggttcttcacggtagaaggcctgcaggtcgagaccaactatggcgcggcacccagctggcaccagccgatcatcaaccaggctgaagtaggtatcctcggcattctcgtcaaggagatcgacggcgtgctgcactgcctcatgtcagcaaagatggaaccgggcaacgtcaacgtcctgcagctctcgccgacggttcaggcaactcggagcaactacacgcaggcacaccgtggcagcgttccgccctatgtggactacttcctcgggcggggccgcggccgcgtgctggtagacgtgctccagtctgaacaggggtcctggttctaccggaagcgcaaccggaacatggtggtggaagtccaggaggaagtgccagtcctgccagacttctgctggttgacgctcggccaggtgctggctctccttcgtcaggacaacatcgtcaacatggacacccggacggtgctgtcttgcatcccgttccacgattccgccaccggacccgaactagccgcctcggaggagcccttccgacaggcggtggccaggtcgctctcgcacggcatcgattcgtcgagtatctccgaggcggtcggttggttcgaggaagccaaggcccgctaccgcttgcgggcaacgcgcgttccgctgagcagggtcgacaagtggtatcgcaccgataccgagatcgcccaccaggacggcaagtacttcgcggtgatcgcggtgtcggtgtccgcgaccaatcgtgaggtcgccagctggacgcagccgatgatcgaaccgcgagaacaaggtgagatcgcactgttggtcaagcggatcggcggagtgctgcacggtttggtccacgctcgggtggaggctgggtataagtggactgcggaaatcgctcccacggtccagtgcagtgtggccaactaccaaagcaccccgtcgaacgactggccgccgttcttggacgacgtgctcaccgccgatcccgaaaccgtgcggtacgaatcgatcctgtccgaagaaggcggtcggttctaccaggcgcagaacaggtaccggatcatcgaggtgcatgaggacttcgcggcacgacctcccagcgacttccggtggatgactttgggacagttgggcgagctgctccggagcacccacttcttgaacatccaggcgcgcagcttggtcgcctccctgcatagcttgtgggcgttggggcgatga

SEQ ID NO: 26 - protein, 486 aa, Saccharopolyspora spinosa
MSSSVEAEASAAAPLGSNNTRRFVDSALSACNGMIPTTEFHCWLADRLGENSFETNRIPFDRLSKWKFDASTENLVHADGRFFTVEGLQVETNYGAAPSWHQPIINQAEVGILGILVKEIDGVLHCLMSAKMEPGNVNVLQLSPTVQATRSNYTQAHRGSVPPYVDYFLGRGRGRVLVDVLQSEQGSWFYRKRNRNMVVEVQEEVPVLPDFCWLTLGQVLALLRQDNIVNMDTRTVLSCIPFHDSATGPELAASEEPFRQAVARSLSHGIDSSSISEAVGWFEEAKARYRLRATRVPLSRVDKWYRTDTEIAHQDGKYFAVIAVSVSATNREVASWTQPMIEPREQGEIALLVKRIGGVLHGLVHARVEAGYKWTAEIAPTVQCSVANYQSTPSNDWPPFLDDVLTADPETVRYESILSEEGGRFYQAQNRYRIIEVHEDFAARPPSDFRWMTLGQLGELLRSTHFLNIQARSLVASLHSLWALGR

SEQ ID NO: 27 - DNA, 524 bp, Saccharopolyspora spinosa
  CDS (1)..(438): ORF11; thioesterase
gtgagcaacgtgtggccggaaacatggacgccggggtttggcaggtgttcatcgctgttgcgtcgactcggattccgccgtgaccgggacgatgccaggcgagtcccgaagtcagattcttgtccagaatcgtccaatggggtgttgatctccccagaggtttgcgctccaaccgatttccgacgaggatcgtggcgcccgctgagcaacgactaccgtgcggtcgagacataccgctgtgcgccaggagcgaaggtgggttgcccgatcaccgtgctggtggtagatgccgagccgaaggtcaccttggatgaggcggaagcctggcgagagcacaccgaggccgtggccgacgtccgtgtcttctccggcgggcatttcttcatgaccgaacgccaggacgaggtgctcgcggtccttacgggcggatcgcttcgatgatcctcgccaggccgctggaccagaccgcgacgcccctgggagccggcgtgcacatcgtcacggcagtgagggattgggcatga

SEQ ID NO: 28 - protein, 146 aa, Saccharopolyspora spinosa
VSNVWPETWTPGFGRCSSLLRRLGFRRDRDDARRVPKSDSCPESSNGVLISPEVCAPTDFRRGSWRPLSNDYRAVETYRCAPGAKVGCPITVLVVDAEPKVTLDEAEAWREHTEAVADVRVFSGGHFFMTERQDEVLAVLTGGSLR

SEQ ID NO: 29 - DNA, 1320 bp, Saccharopolyspora spinosa
  CDS (1)..(1317): ORF12; glycosyltransferase
atgcgtgtcctgttcaccccgctgccggcgagttcgcacttcttcaacctggtgccgttggcgtgggcgttgcgtgccgcggggcacgaggtccgtgtcgccatctgcccgaatatggtgtcgatggtcaccggagcaggactcaccgcggttcccgtcggcgacgagctcgacctcatctccttggcggccaagaacgaactcgttctcggcagcggggtctcgttcgacgagaaggggcggcatccggaactcttcgacgagctgctgtcaatcaactccggcagagacacggacgccgtggagcaactccaccttgtggatgaccgatcgctggacgatctcatggggttcgccgagaaatggcagcctgatctcgttgtgtgggacgctatggtgtgttcggggccagttgtggcgcgagcgctcggcgcacgacacgtgcggatgctcgtcgccctcgatgtgtcggggtggctgcggtccggtttcctcgaataccaggaatcgaagccgcctgagcagcgcgtcgacccgctcgggacgtggctgggagcgaagctcgccaagttcggagccacgttcgatgaagagatcgtgacgggccaagcgaccatagatccgattccatcctggatgcgcctgcctgtggacttggactacatctcgatgcgtttcgtgccgtacaacggtccggcggtgttgccggagtggttgcgcgaacgaccgacgaagccgcgcgtctgcatcacgcgcgggctgaccaagcggcggctgagcagggtgaccgaacagtacggggagcaaagtgaccaggaacaagcaatggtggaaaggttgttgcgcggcgcggccaggctcgacgtcgaggtgatcgccaccttgtctgacgacgaagtacgggagatgggggagttgccctcgaacgtccgggtccacgaatacgtaccgctcaacgaactgctggagtcgtgttcagtgatcatccatcatggctcgacgacgacgcaggaaaccgccacggtcaacggcgtaccgcagttgattctccctgggaccttctgggacgaatctcgtagggcggagctcctagccgatcggggagccggtctggtcctcgaccccgcgacgtttaccgaagacgacgtgcgaggtcagctggcccgcctgctcgacgagccgtcgttcgctgccaacgcggcgctgatccgccgtgaaatcgaggaaagtcccagcccgcacgacatcgttccacgtctggaaaagctagttgccgaacgtgagaaccgccgcactgggcagtctgatggccatccgtga

SEQ ID NO: 30 - protein, 439 aa, Saccharopolyspora spinosa
MRVLFTPLPASSHFFNLVPLAWALRAAGHEVRVAICPNMVSMVTGAGLTAVPVGDELDLISLAAKNELVLGSGVSFDEKGRHPELFDELLSINSGRDTDAVEQLHLVDDRSLDDLMGFAEKWQPDLVVWDAMVCSGPVVARALGARHVRMLVALDVSGWLRSGFLEYQESKPPEQRVDPLGTWLGAKLAKFGATFDEEIVTGQATIDPIPSWMRLPVDLDYISMRFVPYNGPAVLPEWLRERPTKPRVCITRGLTKRRLSRVTEQYGEQSDQEQAMVERLLRGAARLDVEVIATLSDDEVREMGELPSNVRVHEYVPLNELLESCSVIIHHGSTTTQETATVNGVPQLILPGTFWDESRRAELLADRGAGLVLDPATFTEDDVRGQLARLLDEPSFAANAALIRREIEESPSPHDIVPRLEKLVAERENRRTGQSDGHP

SEQ ID NO: 31 - DNA, 1389 bp, Saccharopolyspora spinosa
  CDS (1)..(1386): ORF13; 3,4-dehydratase
atgcagagccggaaaaccagagcgctggggaaagggcgcgccagagtgacttcgtgtgacgacacttgcgctaccgctactgagatggtgccggatgccaaggaccggatattggcatccgtacgcgattaccaccgcgaacaggaatccccgaccttcgtggctggatcgacgccgatccggccatcgggcgccgtgctcgacgaggacgaccgggtggcactggtggaagccgcgctggagctccggatcgccgcgggcgggaatgcacggcgattcgagagcgagttcgcccgcttcttcggcctccgcaaggctcatctcgtcaactccggttcgtcggccaatctcctggcactgagttcgcttacctcccccaaactcggcgaggcacgactgcggcccggcgacgaagtgatcactgcggcggtcggcttccccacgacgatcaatccggcggtccaaaacggactcgtcccggtattcgtcgacgtggaactgggcacctacaacgcaacgccagaccgcatcaaggccgccgtcacggaacggacgcgagccatcatgctggcgcacaccctgggcaaccccttcgccgctgacgaaatcgcggagatcgcaaaagaacacgagctgttcctcgtcgaagacaactgtgatgcggtgggatccacctaccggggacggctgaccggaaccttcggcgacctgacaacggtcagcttctatcctgcccatcacatcaccagcggcgagggtggctgcgtgttgaccggcagcctggaattggctcgcatcatcgagtcgctgcgtgactggggacgggattgctggtgcgagcccggcgtggacaacacctgccgcaagaggttcgactaccacctcggtacccttccaccgggctacgaccacaagtacacgttctcccacgtcggttacaacctcaagaccaccgacctgcaggccgcacttgcgctgagccagttgagcaagatttccgcattcgggtcggcacgccgccgtaactggcgacggttgcgcgaagggctgtccgggttgccgggcctgctgctgccggtagccacaccgcacagcgacccgagctggttcgggtttgcgatcaccatcagtgcggacgccgggttcacccgtgccgccctggtgaacttcctggaatcccgcaacatcggcacccgactgctgttcggcggtaacatcacccggcacccggccttcgagcaggtgcggtaccggatcgccgacgcgctcaccaacagcgacatcgtcaccgaccgaaccttctgggtcggcgtctacccaggcataacggaccaaatgatcgactacgtcgtcgaatcaatcgctgaattcgtggccaagagttcctag

SEQ ID NO: 32 - protein, 462 aa, Saccharopolyspora spinosa
MQSRKTRALGKGRARVTSCDDTCATATEMVPDAKDRILASVRDYHREQESPTFVAGSTPIRPSGAVLDEDDRVALVEAALELRIAAGGNARRFESEFARFFGLRKAHLVNSGSSANLLALSSLTSPKLGEARLRPGDEVITAAVGFPTTINPAVQNGLVPVFVDVELGTYNATPDRIKAAVTERTRAIMLAHTLGNPFAADEIAEIAKEHELFLVEDNCDAVGSTYRGRLTGTFGDLTTVSFYPAHHITSGEGGCVLTGSLELARIIESLRDWGRDCWCEPGVDNTCRKRFDYHLGTLPPGYDHKYTFSHVGYNLKTTDLQAALALSQLSKISAFGSARRRNWRRLREGLSGLPGLLLPVATPHSDPSWFGFAITISADAGFTRAALVNFLESRNIGTRLLFGGNITRHPAFEQVRYRIADALTNSDIVTDRTFWVGVYPGITDQMIDYVVESIAEFVAKSS

SEQ ID NO: 33 - DNA, 1158 bp, Saccharopolyspora spinosa
  CDS (1)..(1155): ORF14; 4-aminotransferase
gtgatcaacctgcaccagccgatcctcggcaccgaagaactcgacgcgatcgcggaggtgttcgcctccaactggatcgggctcgggccgcgcacccggacgttcgaggccgaattcgcccaccacctgggagtggatcccgaacaggtcgtgttcctcaactcggggactgccgcgctgttccttaccgtgcaggtgctcgacctcggcccaggcgacgacgtggtacttccttcgataagcttcgtggcggcggccaacgccatcgcatcctccggtgcccgcccggtgttctgcgacgtcgacccccggacgttgaaccccacgctggatgatgtggcgagggccatcacgccggcgaccaaggccgtattgctgctccactatggaggatcgccgggagaagtcaccgcgatcgccgatttctgccgtgaaaagggcctcatgctcatcgaggactccgcctgcgcggtggcatcgtccgtgcacggcaccgcttgcggaacctttggtgacctggccacgtggagtttcgatgcgatgaagatcctggtcaccggggatgggggcatgttctacgcggcggatccggagctggcgcaccgcgcaagacgactcgcctaccacggtcttgagcagatgagcggattcgattcggccaagtcttccaaccgctggtgggatattcgcgtcgaagacatcggccagcggctgatcgggaacgacatgacggcagcgcttggcagcgtgcagctgcgcaaactgccagaattcatcaacaggcgtagagaaatcgctacgcagtacgaccggttgctttccgatgtgccgggtgtcctcctaccgccgacgctaccggatgggcacgtctcgtcacactacttctactgggtccagctggctccggagatccgcgaccaggtggcgcagcaaatgctggaacgcggcatctacacgagctaccgctacccgcccctgcacaaggtccccatctaccgcgcggactgcaagctgccttctgcggagcacgcctgccgcagaacactcctgctaccactgcacccaagccttgacgacgccgaggtgcgcacggtggctgacgagttccagaaggccgtcgaacaccacatcagccaaagatcaccactccgaaagtga

SEQ ID NO: 34 - protein, 385 aa, Saccharopolyspora spinosa
VINLHQPILGTEELDAIAEVFASNWIGLGPRTRTFEAEFAHHLGVDPEQVVFLNSGTAALFLTVQVLDLGPGDDVVLPSISFVAAANAIASSGARPVFCDVDPRTLNPTLDDVARAITPATKAVLLLHYGGSPGEVTAIADFCREKGLMLIEDSACAVASSVHGTACGTFGDLATWSFDAMKILVTGDGGMFYAADPELAHRARRLAYHGLEQMSGFDSAKSSNRWWDIRVEDIGQRLIGNDMTAALGSVQLRKLPEFINRRREIATQYDRLLSDVPGVLLPPTLPDGHVSSHYFYWVQLAPEIRDQVAQQMLERGIYTSYRYPPLHKVPIYRADCKLPSAEHACRRTLLLPLHPSLDDAEVRTVADEFQKAVEHHISQRSPLRK

SEQ ID NO: 35 - DNA, 750 bp, Saccharopolyspora spinosa
  CDS (1)..(747): ORF15; N-dimethyltransferase
atgtcgcgcgtgagcgacacattcgcagaaacctcctcggtatacagcccagatcatgccgacatctacgacgcgatccactccgcgcgtggccgggactgggcagccgaggccggggaagtagtccagctcgtacgcaccaggctgcccgaagcacagtccctactcgacgtcgcctgtgggaccggggcgcacctagagcgattccgtgccgaatacgcgaaggtcgcggggcttgaactgtccgatgcgatgcgggagatcgcgatcagacgagtccctgaggtaccgattcacatcggtgacatccgcgatttcgacctcggcgagccattcgacgtcatcacctgcctgtgctttaccgcggcttacatgcggaccgttgacgacctgcgacgcgtgacgcggaacatggcccggcacctggcccctggtggagtcgcggtcatcgaaccctggtggtttcccgacaagttcatcgacgggttcgtcaccggagccgtcgcgcaccacggcgagcgggtgatcagccggctatcgcactcggtcctggagggccgtacgagccggatgaccgtccgctacacagtcgccgaacccaccgggatccgggacttcacagagttcgaaatcctctcgctgttcactgaggacgagtacaccgccgcgctcgaagacgcagggatccgcgcggaataccttcctggagcaccgaacggccgaggcctgttcgtcggaatccgcaactga

SEQ ID NO: 36 - protein, 249 aa, Saccharopolyspora spinosa
MSRVSDTFAETSSVYSPDHADIYDAIHSARGRDWAAEAGEVVQLVRTRLPEAQSLLDVACGTGAHLERFRAEYAKVAGLELSDAMREIAIRRVPEVPIHIGDIRDFDLGEPFDVITCLCFTAAYMRTVDDLRRVTRNMARHLAPGGVAVIEPWWFPDKFIDGFVTGAVAHHGERVISRLSHSVLEGRTSRMTVRYTVAEPTGIRDFTEFEILSLFTEDEYTAALEDAGIRAEYLPGAPNGRGLFVGIRN

SEQ ID NO: 37 - DNA, 726 bp, Saccharopolyspora spinosa
  CDS (1)..(723): ORF16; 3,4-reductase
atgagcgaacagacgattgcactggtcaccggcgcaaacaagggaatcggatacgagatcgcggccgggctcggcgcgctggggtggagcgtcggaatcggggcacgggaccaccagcgcggggaggatgccgtggcgaaattgcgtgcggacggcgtcgatgcgttcgcggtatccctggacgtgacagacgacgcgagcgtcgcggctgctgcggctctgctcgaggagcgcgccggccggctcgatgtgctggttaataacgccggcatcgccggggcatggccggaggagccctcgaccgtcacaccggcgagcctccgggcggtggtggagaccaacgtgatcggcgtcgttcgggttaccaacgctatgctgccgttgctacgccgctccgagcgcccgcggatcgtcaaccagtccagccacgtcgcttccctgaccttgcaaaccacgccgggcgtcgacctcggcgggatcagcggagcctactcaccgtcgaagacgttcctcaacgcgatcaccatccagtacgccaaggaactcagcgataccaacatcaaaatcaacaacgcctgccccggctacgtcgcgaccgaccttaacggcttccacggaaccagcacgccggcagacggtgccaggatcgccattcggctcgccacgctgccagacgacggcccgaccggaggcatgttcgacgacgccgggaatgtgccctggtga

SEQ ID NO: 38 - protein, 241 aa, Saccharopolyspora spinosa
MSEQTIALVTGANKGIGYEIAAGLGALGWSVGIGARDHQRGEDAVAKLRADGVDAFAVSLDVTDDASVAAAAALLEERAGRLDVLVNNAGIAGAWPEEPSTVTPASLRAVVETNVIGVVRVTNAMLPLLRRSERPRIVNQSSHVASLTLQTTPGVDLGGISGAYSPSKTFLNAITIQYAKELSDTNIKINNACPGYVATDLNGFHGTSTPADGARIAIRLATLPDDGPTGGMFDDAGNVPW

SEQ ID NO: 39 - DNA, 837 bp, Saccharopolyspora spinosa
  CDS (1)..(834): ORF17; transcription regulator
atggagacgcgggagttgcggtacttcgttgcagtcgccgaggagttgcacttcggccgggccgcccagcgcctgggcatcgcccagccgccgctgtcgcggacgatcgcccagctcgagcaacgactcggagtcgtgttgctgcaacgcaccagccgcaaagtctcgctcaccgaagccggggcaatgctgctgaccgaaggccgggcgatcctcggcgcgctggcagcagccgagcgacgcacccagcgtgccgcgacgagccagccctcgctagtcctggctgccaaggccggcgcctccggtgagctgctggcgaagttgctcgacgcgtacgccgccgagccgggagccgtggccgtcgacctgctgctctgcgaatcccagccccagaaaacgctgcatgacggccgggccgacgtggcgctgttgcatcaacccttcgacccgacggccgaactcgacatcgaaattctgaacaccgagcaacaagtcgccattcttccgacctcgcatccgcttgccagcgagccccatgtacggatggcggatgtcagctcactgccggatctcccgcttgcgcgctggcccggccccgacggcgtctatccagatggccccggcgtggaagtacgcaaccagacgcaactgttccaaatgatcgcactcggccgcactaccgtggtcatgcccgaatccagtcgcgtcaacctgctcgaaggcctcgccgccgtaccggttctagacgcgccggacgtgacgacagtcatcgcctggccgccccacagccgctcccgagcactcgccggcttggtccgcgtggccacactcctctaa

SEQ ID NO: 40 - protein, 278 aa, Saccharopolyspora spinosa
METRELRYFVAVAEELHFGRAAQRLGIAQPPLSRTIAQLEQRLGVVLLQRTSRKVSLTEAGAMLLTEGRAILGALAAAERRTQRAATSQPSLVLAAKAGASGELLAKLLDAYAAEPGAVAVDLLLCESQPQKTLHDGRADVALLHQPFDPTAELDIEILNTEQQVAILPTSHPLASEPHVRMADVSSLPDLPLARWPGPDGVYPDGPGVEVRNQTQLFQMIALGRTTVVMPESSRVNLLEGLAAVPVLDAPDVTTVIAWPPHSRSRALAGLVRVATLL

SEQ ID NO: 41 - DNA, 7788 bp, Saccharopolyspora spinosa
  CDS (1)..(7785): ORF18; polyketide synthase
atgagcgaagccgggaacctgatagccgtcatcggactgtcctgccgcctaccccaggcgcctgacccggcttccttctggcggttgctgcgcaccggaacggacgccatcaccacggtcccggaagggcggtggggcgacccgttgcctggtcgggatgcgcccaagggcccggaatggggtggtttcctggctgatgtcgactgcttcgatcccgagttcttcgggatctcgccgcgagaagcggcagccgtggatccccagcagaggctggctctggagctcgcctgggaggcactcgaagacgccggtatccccgccggcgagctgcgcggtactgccgccggtgtgttcatgggggcgatctctgacgactacgccgccctgctgcgcgagagcccgccggaagtggctgcgcagtaccgcctcaccggcacccatcgaagcctgatcgccaaccgcgtgtcctatgtgctcggcctgcgcgggccaagcctgacggtggattcaggtcagtcctcgtccctggtcggcgtgcatctcgccagcgagagcctgcgacggggtgagtgcacgatcgcactcgccggcggcgtgaacctcaacctggccgccgagagcaacagcgctctgatggacttcggcgcgctctccccggacggtcgctgcttcaccttcgatgtgcgggcgaacggttacgtccgtggtgagggcggcggccttgtcgtgctgaagaaggccgatcaggcgcacgccgatggcgaccggatctactgcctcatccgcggcagcgcggtcaacaacgatgggggcggtgccgggctcaccgttccggcggcggacgcccaggcggagctgctgcgccaggcataccggaacgcgggcgtcgacccggccgccgtgcagtatgtcgagctccacggcagcgcgaccagggtcggggatcccgtcgaagcagcagccctcggagctgtcctgggggcggcgagacggcccggcgacgagctgcgtgtggggtcggcgaagaccaacgtcggccatctggaagcagcggcgggcgtcaccgggttgctgaagaccgcactcagcatctggcaccgcgaactgccgccgagtcttcatttcaccgcccccaacccggaaatcccgctggacgaattgaacctacgcgtccagcgtgatctgcggccgtggccggagagcgaggggccgctgctggccggcgtcagcgccttcggaatgggaggcacgaactgccacctggtgctctccggcacgtcccgggtggagcgacggcgcagtggacccgctgaggcgaccatgccgtgggtcttgtcggccagaacaccggtcgcattgcgtgcgcaggcggcgcgcttgcacacgcacctcaatacggccggtcaaagtccgttggacgtcgcctactcactggcgaccactcgatccgcgctgccgcaccgggccgcgctggtcgcggacgacgaaccgaaactgctcgccgggttgaaggccctcgctgacggcgacgacgcgcccacgctgtgccacggcgcgacttccggcgagcgggcagcggtcttcgtctttcccggacagggcagccagtggatcgggatgggtaggcagctgctcgaaacctccgaggttttcgcggcgtcgatgtcggactgcgccgacgcattggcgccgcacctggattggtccctgctggatgtgctgcgcaacgcggccggcgctgcgcaccttgaccacgacgatgtcgtccagcccgcgctgttcgccatcatggtctcgctcgcggagctctggcgttcgtggggcgtgcgtccggtggcggtcgtcgggcactcgcagggggagatcgcggcggcctgcgtcgccggggccctgtccgtccgcgatgccgccagggtggtggcggtgcgcagcaggcttctgacggcgctggccggcagtggcgcgatggcctcgttgcagcatcccgccgaagaggtgcggcaaatcctgttgccctggcgcgatcggatcggcgtggcgggggtgaacggaccgtcgtcgaccctggtgtcaggggaccgggaggcgatggcggaactgctggccgagtgcgcagaccgagagctccggatgcgccggattcccgttgaatacgcctcccattcgcctcacatcgaggttgtccgggatgagctgctggggctgttggcgccggtcgaacccaggacgggaagcatcccgatctattcgacgacgaccggggacctgctggaccggccgatggacgccgactactggtaccgcaaccttcgtcaaccggtgctgttcgaagcggccgtcgaggccctgttgaagcgggggtacgacgcattcatcgagatcagcccacacccggtgctgactgcgaacatccaggaaaccgccgtgcgagcagggcgggaggtagtggcgctcgggacactccgccgcggcgaaggtggcatgcggcaggcgctgacgtcgctggccagagcacacgtacacggagtggccgcggactggcacgcggtcttcgccggtaccggggcgcagcgggtcgacctgccgacgtacgcctttcagcgacagcgctactggctggacgcgaagcttcccgacgtcgccatgcccgagagcgacgtgtcgacggcgttgcgggaaaagctgcggtcttcgccgagggcggacgtggactcgacgaccctcacgatgatccgggcacaggcagccgtggtcctcggccactccgatccgaaagaggtggacccggatcggacgttcaaggacctgggcttcgattcctcgatggtggtcgagctgtgcgaccgcctaaacgccgccacaggtctgcgactcgcaccgagcgtcgttttcgactgtcctacgccggacaagctcgcccgccaggtacggacgttgttgttgggcgagccggctcccatgacgtcacaccggccggactccgatgcggacgagcctatcgccgtgatcgggatgggctgtcggtttccgggtggggtgtcctcgcccgaggagttgtggcagttggtcgccgctgggcgggacgtcgtgtccgagttcccggctgaccgaggttgggacctggagcgtgcggggacatcgcacgtgcgcgccggcgggttcttgcatggcgccccggattttgaccccgggttcttccggatttcgccgcgcgaggcgttggcgatggatccacagcagcggttgctgctggaaatcgcctgggaagcagtcgaacgaggcgggatcaacccgcagcacctgcacggaagtcaaaccggggtcttcgtcggcgcgacctccctggactacgggccacgcctgcacgaagcgtccgaggaggcggccgggtacgtgctcaccggcagcaccacgagtgtggcgtcgggtcgggttgcgtattcgttcgggttcgagggccctgcggtgacggtggatacggcgtgttcgtcgtcgttggtggccctgcatttggcgtgtcagtcgttgcgttcgggtgagtgtgatctggcgttggccggtggtgtgaccgtgatggccacgccggggatgttcgtggagttttcgcggcagcgtggtttggcgccggatgggcggtgcaagtcgttcgcggaggccgccgacggcaccggctggtccgagggtgctggcctggttctactggagcggttgtcggatgcccggcggaatgggcatgaggtgctggcggttgttcgtggtagtgcggtgaatcaggacggtgcgtcgaatggtttgaccgcgccgaatggttcgtcgcagcagcgggtgattgcccaggcattggcgagtgcggggttgtcggtgtccgatgtggatgctgtggaggcgcatgggacgggcacgcggcttggtgatccgatcgaggcgcaggcgctgatcgccacctacggccagggccggcttccggaacggccattgtggttgggctcgatgaagtcgaacatcggtcacgcgcaggcagctgcggggatagccggcgtcatgaagatggtgatggcgatgcggcacgggcagctaccgcgcacgttgcacgtggatgagccgacttctggggtggattggtcggcggggacggttcaactccttacggagaacacgccctggcccgggagtggtcgtgttcgtcgggtgggggtgtcgtcgttcgggatcagtggtactaacgcgcacgtcatcctcgaacagcccccgggagtgccgagtcagtctgcggggccgggttcgggctctgtcgtggatgttccggtggtgccgtggatggtgtcgggcaaaacacccgaagcgctatccgcgcaggcaacggcgttgatgacctatctggacgagcgacctgatgtctcctcgctggatgttgggtactcgctggcgttgacacggtcggcgctggatgagcgagcggtggtgctggggtcggaccgtgaaacgttgttgtgcggtgtgaaagcgctgtctgccggtcatgaggcttctgggttggtgaccggatctgtgggggctgggggccgcatcgggtttgtgttttccggtcagggtggtcagtggctggggatgggccgggggctttaccgggcttttccggtgttcgctgctgcctttgacgaagcttgtgccgagctggatgcgcatctgggccaggaaatcggggttcgggaggtggtgtccggttcggatgcgcagttgctggatcggacgttgtgggcgcagtcgggtttgttcgcgttgcaggtgggcttgctgaagttgctggattcgtggggggttcggccgagtgtggtgttggggcattcggtgggcgagttggcggcggcgttcgcggcgggtgtggtgtcgttgtcgggtgcggctcggttggtggcgggtcgtgcccggttgatgcaggcgttgccgtctggcggtgggatgctggcggtgcctgctggtgaggagctgttgtggtcgttgttggccgatcagggtgatcgtgtggggatcgccgcggtcaacgctgcggggtcggtggtgctctctggtgatcgggatgtgctcgatgaccttgccggtcggctggacgggcaagggatccggtcgaggtggttgcgggtgtcgcatgcgtttcattcgtatcggatggatccgatgctggcggagttcgccgaattggcacgaaccgtggattaccggcgttgtgaagtgccgatcgtgtcgaccttgaccggagacctcgatgacgctggcaggatgagcgggcccgactactgggtgcgtcaggtgcgagagccggtccgcttcgccgacggtgtccaggcgctggtcgagcacgatgtggccaccgttgtcgagctcggtccggacggggcgttgtcggcgctgatccaggaatgtgtcgccgcatccgatcacgccgggcggctgagcgcggtcccggcgatgcgcaggaaccaggacgaggcgcagaaggtgatgacggccctggcacacgtccacgtacgtggtggtgcggtggactggcggtcgttcttcgccggtacaagggcgaagcaaatcgagctgcccacctacgccttccaacgacagcggtactggctgaacgcgctgcgtgaatcttccgccggcgacatgggcaggcgtgtcgaagcgaagttctggggcgccgtcgagcacgaagatgtggaatcgcttgcacgcgtattgggcattgtggacgacggcgctgctgtggattccctgagaagcgcccttccggtgttggccggttggcagcgaacccgcaccaccgagtccattatggatcagcggtgttaccgaattggctggcggcaggtagccggactcccgccgatgggaactgttttcggtacctggctggtcttcgcgcctcatggctggtccagcgaaccggaggtggtggactgcgttacggcactgcgggcacgtggtgcctcggtggtgttggtggaagctgatcccgacccgacctccttcggcgaccgggtacgaaccctgtgttcgggccttccggatcttgttggcgtgttgtcaatgttgtgcttggaagaatcggtccttccgggattttctgcggtgtcacggggttttgcgttgaccgtggagttggtgcgggttttgcgggcagctggtgcgactgcccggttgtggttgctgacgtgtggtggcgtgtcggtgggagatgtaccggttcgtccagcgcaggccctggcgtgggggttggggcgtgttgtggggttggagcatccggactggtggggcggcttgatcgatattccggtcttgttcgacgaagacgctcaagagcggttgtcgattgtgctggcaggtctcgatgaggacgaggtcgcgatccgtcctgacggcatgttcgcgcgtcggttggtacgccacactgtctcagctgatgtgaagaaggcgtggcgccccaggggatcggtgctggtgacgggcggcacgggtggtttgggggcgcacgttgctcgctggctggccgacgccggagccgaacatgtggcgatggtgagtcgacgcggcgagcaggcaccgagtgctgagaagttgcggacggaactggaggatctgggtacccgggtgtcgatcgtgtcatgcgatgtgaccgatcgcgaggcgctcgccgaagtgctgaaagcccttccggctgaaaacccgttgaccgcggtagtgcatgcggcaggcgtgatcgagactggtgatgcggcggcaatgagcctggctgatttcgatcacgtgttgtccgcaaaggtggccggtgccgcgaatctggatgccttgttggccgatgtggaattggacgcgttcgtcttgttctcatcggtgtcaggagtttggggcgctgggggacacggggcttacgcagcggcgaatgcctatctggatgcgctcgcggaacagcgtcggtcgcgagggctggtcgcgactgcggtggcctgggggccgtgggccggcgagggcatggcctccggagaaacaggagaccagctgcgccgatacggcctttccccaatggctccgcagcacgccatcgccggaatccggcaggccgtggaacaggacgaaatttccctggtagtggccgatgtcgattgggcacgtttcagcgcgggattgctggcggctaggccgcggccgctgctgaacgaactggccgaggtcaaggaactcctcgtcgatgcccagcccgaggcgggagtccttgccgacgcgtcgttggaatggcggcagcgattgtccgcggcaccgaggccgacacaggaacagctgatcctggagctggtacgcggcgaaaccgctctggtgctgggacaccccggggcagcggccgttgcatcggaacgagccttcaaggacagcggattcgactcgcaggccgcggtcgaactccgcgttcggctcaatcgagctaccggcctccagttgccatcgacaattatcttcagccatcccacgcctgcggaactggctgcggagctgcgggcgaggcttcttcccgagtccgcaggagcaggcattcccgaggaggacgaggcgcgaatcagagcggcactgacgtcgatcccgttcccggccttgcgcgaggcaggcttggtgagtccgctgctcgcacttgccggacacccggtcgactccggtatctcctcggacgatgcggccgcgacctcgatcgatgcgatggatgtagccggcctcgtcgaagcagcgctgggcgaacgcgagtcctga

SEQ ID NO: 42 - protein, 2595 aa, Saccharopolyspora spinosa
MSEAGNLIAVIGLSCRLPQAPDPASFWRLLRTGTDAITTVPEGRWGDPLPGRDAPKGPEWGGFLADVDCFDPEFFGISPREAAAVDPQQRLALELAWEALEDAGIPAGELRGTAAGVFMGAISDDYAALLRESPPEVAAQYRLTGTHRSLIANRVSYVLGLRGPSLTVDSGQSSSLVGVHLASESLRRGECTIALAGGVNLNLAAESNSALMDFGALSPDGRCFTFDVRANGYVRGEGGGLVVLKKADQAHADGDRIYCLIRGSAVNNDGGGAGLTVPAADAQAELLRQAYRNAGVDPAAVQYVELHGSATRVGDPVEAAALGAVLGAARRPGDELRVGSAKTNVGHLEAAAGVTGLLKTALSIWHRELPPSLHFTAPNPEIPLDELNLRVQRDLRPWPESEGPLLAGVSAFGMGGTNCHLVLSGTSRVERRRSGPAEATMPWVLSARTPVALRAQAARLHTHLNTAGQSPLDVAYSLATTRSALPHRAALVADDEPKLLAGLKALADGDDAPTLCHGATSGERAAVFVFPGQGSQWIGMGRQLLETSEVFAASMSDCADALAPHLDWSLLDVLRNAAGAAHLDHDDVVQPALFAIMVSLAELWRSWGVRPVAVVGHSQGEIAAACVAGALSVRDAARVVAVRSRLLTALAGSGAMASLQHPAEEVRQILLPWRDRIGVAGVNGPSSTLVSGDREAMAELLAECADRELRMRRIPVEYASHSPHIEVVRDELLGLLAPVEPRTGSIPIYSTTTGDLLDRPMDADYWYRNLRQPVLFEAAVEALLKRGYDAFIEISPHPVLTANIQETAVRAGREVVALGTLRRGEGGMRQALTSLARAHVHGVAADWHAVFAGTGAQRVDLPTYAFQRQRYWLDAKLPDVAMPESDVSTALREKLRSSPRADVDSTTLTMIRAQAAVVLGHSDPKEVDPDRTFKDLGFDSSMVVELCDRLNAATGLRLAPSVVFDCPTPDKLARQVRTLLLGEPAPMTSHRPDSDADEPIAVIGMGCRFPGGVSSPEELWQLVAAGRDVVSEFPADRGWDLERAGTSHVRAGGFLHGAPDFDPGFFRISPREALAMDPQQRLLLEIAWEAVERGGINPQHLHGSQTGVFVGATSLDYGPRLHEASEEAAGYVLTGSTTSVASGRVAYSFGFEGPAVTVDTACSSSLVALHLACQSLRSGECDLALAGGVTVMATPGMFVEFSRQRGLAPDGRCKSFAEAADGTGWSEGAGLVLLERLSDARRNGHEVLAVVRGSAVNQDGASNGLTAPNGSSQQRVIAQALASAGLSVSDVDAVEAHGTGTRLGDPIEAQALIATYGQGRLPERPLWLGSMKSNIGHAQAAAGIAGVMKMVMAMRHGQLPRTLHVDEPTSGVDWSAGTVQLLTENTPWPGSGRVRRVGVSSFGISGTNAHVILEQPPGVPSQSAGPGSGSVVDVPVVPWMVSGKTPEALSAQATALMTYLDERPDVSSLDVGYSLALTRSALDERAVVLGSDRETLLCGVKALSAGHEASGLVTGSVGAGGRIGFVFSGQGGQWLGMGRGLYRAFPVFAAAFDEACAELDAHLGQEIGVREVVSGSDAQLLDRTLWAQSGLFALQVGLLKLLDSWGVRPSVVLGHSVGELAAAFAAGVVSLSGAARLVAGRARLMQALPSGGGMLAVPAGEELLWSLLADQGDRVGIAAVNAAGSVVLSGDRDVLDDLAGRLDGQGIRSRWLRVSHAFHSYRMDPMLAEFAELARTVDYRRCEVPIVSTLTGDLDDAGRMSGPDYWVRQVREPVRFADGVQALVEHDVATVVELGPDGALSALIQECVAASDHAGRLSAVPAMRRNQDEAQKVMTALAHVHVRGGAVDWRSFFAGTRAKQIELPTYAFQRQRYWLNALRESSAGDMGRRVEAKFWGAVEHEDVESLARVLGIVDDGAAVDSLRSALPVLAGWQRTRTTESIMDQRCYRIGWRQVAGLPPMGTVFGTWLVFAPHGWSSEPEVVDCVTALRARGASVVLVEADPDPTSFGDRVRTLCSGLPDLVGVLSMLCLEESVLPGFSAVSRGFALTVELVRVLRAAGATARLWLLTCGGVSVGDVPVRPAQALAWGLGRVVGLEHPDWWGGLIDIPVLFDEDAQERLSIVLAGLDEDEVAIRPDGMFARRLVRHTVSADVKKAWRPRGSVLVTGGTGGLGAHVARWLADAGAEHVAMVSRRGEQAPSAEKLRTELEDLGTRVSIVSCDVTDREALAEVLKALPAENPLTAVVHAAGVIETGDAAAMSLADFDHVLSAKVAGAANLDALLADVELDAFVLFSSVSGVWGAGGHGAYAAANAYLDALAEQRRSRGLVATAVAWGPWAGEGMASGETGDQLRRYGLSPMAPQHAIAGIRQAVEQDEISLVVADVDWARFSAGLLAARPRPLLNELAEVKELLVDAQPEAGVLADASLEWRQRLSAAPRPTQEQLILELVRGETALVLGHPGAAAVASERAFKDSGFDSQAAVELRVRLNRATGLQLPSTIIFSHPTPAELAAELRARLLPESAGAGIPEEDEARIRAALTSIPFPALREAGLVSPLLALAGHPVDSGISSDDAAATSIDAMDVAGLVEAALGERES

SEQ ID NO: 43 - DNA, 6459 bp, Saccharopolyspora spinosa
  CDS (1)..(6456): ORF19; polyketide synthase
atgacggtgaccaccagttacgaagaagttgtcgaggcactgcgagcatcgctcaaggagaacgaacgcctccggcgcggcagggatcggttctccgcggagaaggacgatcccatcgcgatcgtggcgatgagttgtcgttatcccggtcaggtctcctcgccggaggacctgtggcaactggctgccggcggtgtggacgcgatctccgaagttccgggggatcgcggatgggacctggatggcgtgttcgttccggactccgatcgtcctggcacgtcgtatgcctgcgcgggcggttttcttcagggcgtgtcggagttcgacgcgggtttcttcgggatttcgccgcgtgaggcgctggcgatggatccgcagcagcggttgctgctggaagtcgcgtgggaggtcttcgagcgggctgggctggagcagcggtcgacacgcggttcccgcgttggcgtgttcgtcggcaccaatggccaggactacgcgtcgtggttgcggacgccgccgcctgcggtggcaggtcatgtgctgacgggcggtgcggcagcggttctttcgggccgggttgcgtattcgttcgggttcgagggtcctgcggtgacggtggatacggcgtgttcgtcgtcgttggtggcgttgcacctggcggggcaagcactgcgggccggtgagtgcgaccttgcccttgccggtggcgtcacggtgatgtcgacgccgaaggtgttcctggagttctcccgccaacggggtctcgcgccggatgggcggtgcaagtcgttcgcggcgggtgcggatggcactggatggggtgagggtgccggactgttgttgctggagcggttgtcggatgcccggcggaatgggcatgaggtgctggcggttgttcgtggtagtgcggtgaatcaggacggtgcgtcgaatggtttgaccgcgccgaatggttcgtcgcagcagcgggtgattacccaggcgttggcgagtgcggggttgtcggtgtccgatgtggatgctgtggaggcgcatgggacgggcacgcggcttggtgatccgatcgaggcgcaggcgctgatcgccacctacggccgtgatcgtgatcctggccggccgttgtggttggggtcggtcaagtcgaacatcggtcatacgcaagcggcggcgggtgtggctggtgtgatcaagatggtgatggcgatgcggcacgggcagctgccacgcacgttgcacgtggaatcgccgtcgccggaggtggattggtcggcggggacggttcaactccttacggagaacacgccctggcccaggagtggtcgtgttcgtcgggtgggggtgtcgtcgttcgggatcagtggtactaacgcgcacgtcatcctcgaacagcccccgggagtgccgagtcagtctgcggggccgggttcgggttctgtcgtggatgttccggtggtgccgtggatggtgtcgggcaaaacacccgaagcgctatccgcgcaggcaacggcgttgatgacctatctggacgagcgacctgatgtctcctcgctggatgttgggtactcgctggcgttgacacggtcggcgctggatgagcgagcggtggtgctggggtcggaccgtgaaacgttgttgtgcggtgtgaaagcgctgtctgccggtcatgaggcttctgggttggtgaccggatctgtgggggctgggggccgcatcgggtttgtgttttccggtcagggtggtcagtggctggggatgggccgggggctttaccgggcttttccggtgttcgctgctgcctttgacgaagcttgtgccgagctggatgcacatctgggccaggaaatcggggttcgggaggtggtgtccggttcggatgcgcagttgctggatcggacgttgtgggcgcagtcgggtttgttcgcgttgcaggtgggcttgctgaagttgctggattcgtggggggttcggccgagtgtggtgttggggcattcggtgggcgagttggcggcggcgttcgcggcgggtgtggtgtcgttgtcgggtgcggctcggttggtggcgggtcgtgcccggttgatgcaggcgttgccgtctggcggtgggatgctggcggtgcctgctggtgaggagctgttgtggtcgttgttggccgatcagggtgatcgtgtggggatcgccgcggtcaacgctgcggggtcggtggtgctctctggtgatcgggatgtgctcgatgaccttgccggtcggctggacgggcaagggatccggtcgaggtggttgcgggtgtcgcatgcgtttcattcgtatcggatggatccgatgctggcggagttcgccgaattggcacgaaccgtggattaccggcgttgtgaagtgccgatcgtgtcgaccttgaccggagacctcgatgacgctggcaggatgagcgggcccgactactgggtgcgtcaggtgcgagagccggtccgcttcgccgacggtgtccaggcgctggtcgagcacgatgtggccactgttgtcgagctcggtccggacggggcgttgtcggcgctgatccaggaatgtgtcgccgcatccgatcacgccgggcggctgagcgcggtcccggcgatgcgcaggaaccaggacgaggcgcagaaggtgatgacggccctggcacacgtccacgtacgtggtggtgcggtggactggcggtcgttcttcgccggtacgggagcgaaacaaatcgagctgcccacctacgccttccaacgacagcggtactggctggtgccatcggattccggtgatgtgacaggtgccggtctggccggggcggagcatccgctgttgggtgctgtggtgccggtcgcgggtggtgacgaggtgttgctgaccggcaggatttcggtgcggacgcatccgtggctggccgaacaccgggtgctgggtgaagtgatcgttgcgggcaccgcgttgctggagatcgccttgcacgcgggggaacgtcttggttgtgaacgggtggaagagctcaccctggaagcaccgctggtcctgccggagcgcggggcgatccaggttcagctgcgagtgggcgcgcccgagaattccggacgcaggccgatggcgctgtattcacgccccgaaggggcggcggagcatgactggacgcggcacgccacgggccggttggcgccaggccgcggcgaggcggctggagacctggccgactggccggctcctggcgcgctgccggtcgacctcgacgaattctatcgggacctcgcagagcttgggctggagtacggcccgatcttccaagggctcaaggcggcctggcggcaaggggacgaggtgtacgccgaagccgcgctgccgggaacggaagattctggtttcggggtgcatccggcactgctggacgcggctctgcacgcaacggctgtccgagacatggatgacgcacgcttgccgttccagtgggaaggtgtgtccctgcacgccaaggccgcgccggctttgcgggtccgcgtggtcccggctggtgacgatgccaagtccctgctggtttgtgatggcaccggtcgaccggtgatctcggtggaccgactcgtattgcggtcggctgcggcccggcggaccggtgcgcgccgacaggcccatcaagctcggttgtaccggttgagctggccaacggttcaactgccgacatccgctcagccaccgtcctgcgtgcttctcggcacctcagaagtgtccgctgacatacaggtgtatccggacctccggtcgttgacggctgcgttggatgccggtgccgaaccacccggcgtcgtcatcgcacccacgccccccggcggtggacgaacagcggatgtccgggagacgactcggcatgcactcgacctggtacaaggctggctttccgatcagcgactcaacgaatcccgattgctcctggtgacacagggagcagtggccgtggagccgggcgaacccgtgaccgatctggcgcaggccgcgctctggggactgctgcggtcgacgcagaccgaacaccctgatcgcttcgtcctcgtcgatgtgcctgagcccgcgcaactcctccccgcgctgccgggggtgctggcctgcggcgaacctcagctcgcgttgcgacgtggcggcgctcatgcgcccagactggctggactgggcagcgatgacgtcctgcccgtgccggacggcaccgggtggcgattggaggccacgcgcccgggaagcctggatgggttggcattggtggacgaaccgacggccacggcaccgctgggtgacggtgaggtcaggattgcgatgcgcgcggccggggtgaacttccgggatgcgctcatcgcgctcggtatgtatcccggtgtggcatcgctgggcagtgagggcgccggggtcgtggtggagaccggccccggcgtcaccggcctggcacccggcgaccgcgtgatgggaatgatcccgaaggcgttcgggccgctcgcggtcgccgaccatcgcatggtgacgaggattcccgctggttggagcttcgcgcgggccgcatcggtgccgatcgtctttctcaccgcctactacgcgctggttgatctcgccgggttgagaccaggggagtcgttgctggttcattcggccgccggtggggtggggatggccgcgatccaactcgccaggcacctcggtgcagaggtgtacgccaccgctagcgaggacaagtggcaagccgtggagctgagccgagaacacctcgcttcgtcgcggacgtgcgatttcgagcagcagttcctcggggcaaccggcggacgcggcgtcgacgtcgtgctcaactccctcgccggggagttcgccgatgcgtctctgcgaatgctgccgcgcggtggccgtttcctggagttggggaagacggatgttcgtgaccccgtcgaggtcgccgatgcgcatccgggcgtgtcttaccaggctttcgataccgtagaggcaggcccgcagcgaatcggcgagatgcttcacgagctggtggagttgttcgagggacgcgtgctggagcccctgcctgtcacggcttgggacgttcggcaggcgcccgaggcgctacggcacctgagccaagcgcggcatgtgggaaagctggtgctcaccatgcctccggtgtgggacgccgcaggcacggttctggttaccggcggaacgggagcacttggcgcagaggtcgcccggcacctcgtgatcgagcgcggggtgcgaaacctggtcctcgtcagcaggcgcggtcccgcagccagtggcgctgctgagctcgtggcgcaactgacggcctacggtgccgaggtttccttgcaggcttgcgatgtcgccgatcgtgagaccttggcgaaggtgcttgccagcatcccggacgagcatccgttgaccgccgtggtgcacgcggctggtgttctcgacgacggagtgtccgaatcgctcaccgtggagcggctggaccaggttctgcgcccgaaggtcgatggcgcgcggaatctgctcgagctgatcgacccggacgtggccctcgtgttgttctcgtcggtgtcgggtgtgctcggcagcggtgggcagggtaactacgcggcggccaactccttcctcgacgcattggcgcagcaaaggcagtcgcgcggcctaccgacgagatcattggcctgggggccctgggcggaacatggcatggccagcaccttgcgcgaagccgagcaggatcgattggcgcgatctgggttgctgccgatctcgaccgaggaggggttgtcccagttcgacgccgcgtgcggcggcgcgcataccgtggtggcgccggttcgattcagccgcttgtccgacgggaacgcgatcaagttctccgtcctgcaaggtttggtcgggccgcatcgcgtcaacaaagcggcgactgcggatgatgccgagagcctccggaaacggttgggacgcttgccggatgcagaacaacatcggattctgctggacctcgtccgcatgcatgtggcggcagtgctcggattcgccggttctcaggagatcaccgcggacggcacgttcaaggtgctgggcttcgactcgttgaccgtggtcgagttgcgcaaccggatcaacggggcgacggggctgcgactgcccgccaccctggtgttcaactacccgacgccggatgcgctcgccgcgcacctcgtcaccgcgctgtccgcagaccgcctggccgggacattcgaggaactcgacaggtgggcggcgaacctgcccacgctggccagggatgaggccacgcgggcgcagatcaccacccggctacaggcgatcttgcagagcctggcggacgtgtccggcggaaccggcggcggctccgtgccggaccggctcagatcggccacggacgacgagcttttccaactcctcgacaacgatctcgaacttccctga

SEQ ID NO: 44 - protein, 2152 aa, Saccharopolyspora spinosa
MTVTTSYEEVVEALRASLKENERLRRGRDRFSAEKDDPIAIVAMSCRYPGQVSSPEDLWQLAAGGVDAISEVPGDRGWDLDGVFVPDSDRPGTSYACAGGFLQGVSEFDAGFFGISPREALAMDPQQRLLLEVAWEVFERAGLEQRSTRGSRVGVFVGTNGQDYASWLRTPPPAVAGHVLTGGAAAVLSGRVAYSFGFEGPAVTVDTACSSSLVALHLAGQALRAGECDLALAGGVTVMSTPKVFLEFSRQRGLAPDGRCKSFAAGADGTGWGEGAGLLLLERLSDARRNGHEVLAVVRGSAVNQDGASNGLTAPNGSSQQRVITQALASAGLSVSDVDAVEAHGTGTRLGDPIEAQALIATYGRDRDPGRPLWLGSVKSNIGHTQAAAGVAGVIKMVMAMRHGQLPRTLHVESPSPEVDWSAGTVQLLTENTPWPRSGRVRRVGVSSFGISGTNAHVILEQPPGVPSQSAGPGSGSVVDVPVVPWMVSGKTPEALSAQATALMTYLDERPDVSSLDVGYSLALTRSALDERAVVLGSDRETLLCGVKALSAGHEASGLVTGSVGAGGRIGFVFSGQGGQWLGMGRGLYRAFPVFAAAFDEACAELDAHLGQEIGVREVVSGSDAQLLDRTLWAQSGLFALQVGLLKLLDSWGVRPSVVLGHSVGELAAAFAAGVVSLSGAARLVAGRARLMQALPSGGGMLAVPAGEELLWSLLADQGDRVGIAAVNAAGSVVLSGDRDVLDDLAGRLDGQGIRSRWLRVSHAFHSYRMDPMLAEFAELARTVDYRRCEVPIVSTLTGDLDDAGRMSGPDYWVRQVREPVRFADGVQALVEHDVATVVELGPDGALSALIQECVAASDHAGRLSAVPAMRRNQDEAQKVMTALAHVHVRGGAVDWRSFFAGTGAKQIELPTYAFQRQRYWLVPSDSGDVTGAGLAGAEHPLLGAVVPVAGGDEVLLTGRISVRTHPWLAEHRVLGEVIVAGTALLEIALHAGERLGCERVEELTLEAPLVLPERGAIQVQLRVGAPENSGRRPMALYSRPEGAAEHDWTRHATGRLAPGRGEAAGDLADWPAPGALPVDLDEFYRDLAELGLEYGPIFQGLKAAWRQGDEVYAEAALPGTEDSGFGVHPALLDAALHATAVRDMDDARLPFQWEGVSLHAKAAPALRVRVVPAGDDAKSLLVCDGTGRPVISVDRLVLRSAAARRTGARRQAHQARLYRLSWPTVQLPTSAQPPSCVLLGTSEVSADIQVYPDLRSLTAALDAGAEPPGVVIAPTPPGGGRTADVRETTRHALDLVQGWLSDQRLNESRLLLVTQGAVAVEPGEPVTDLAQAALWGLLRSTQTEHPDRFVLVDVPEPAQLLPALPGVLACGEPQLALRRGGAHAPRLAGLGSDDVLPVPDGTGWRLEATRPGSLDGLALVDEPTATAPLGDGEVRIAMRAAGVNFRDALIALGMYPGVASLGSEGAGVVVETGPGVTGLAPGDRVMGMIPKAFGPLAVADHRMVTRIPAGWSFARAASVPIVFLTAYYALVDLAGLRPGESLLVHSAAGGVGMAAIQLARHLGAEVYATASEDKWQAVELSREHLASSRTCDFEQQFLGATGGRGVDVVLNSLAGEFADASLRMLPRGGRFLELGKTDVRDPVEVADAHPGVSYQAFDTVEAGPQRIGEMLHELVELFEGRVLEPLPVTAWDVRQAPEALRHLSQARHVGKLVLTMPPVWDAAGTVLVTGGTGALGAEVARHLVIERGVRNLVLVSRRGPAASGAAELVAQLTAYGAEVSLQACDVADRETLAKVLASIPDEHPLTAVVHAAGVLDDGVSESLTVERLDQVLRPKVDGARNLLELIDPDVALVLFSSVSGVLGSGGQGNYAAANSFLDALAQQRQSRGLPTRSLAWGPWAEHGMASTLREAEQDRLARSGLLPISTEEGLSQFDAACGGAHTVVAPVRFSRLSDGNAIKFSVLQGLVGPHRVNKAATADDAESLRKRLGRLPDAEQHRILLDLVRMHVAAVLGFAGSQEITADGTFKVLGFDSLTVVELRNRINGATGLRLPATLVFNYPTPDALAAHLVTALSADRLAGTFEELDRWAANLPTLARDEATRAQITTRLQAILQSLADVSGGTGGGSVPDRLRSATDDELFQLLDNDLELP

SEQ ID NO: 45 - DNA, 9513 bp, Saccharopolyspora spinosa
  CDS (1)..(9510): ORF20; polyketide synthase
atgtcgaatgaagagaagctccgggagtacttgcggcgtgcgctcgtggatctgcaccaggcgcgcgagcggctgcacgaggcggagtcgggagagcgggaacccatcgcgatcgtggcgatgggctgccggtacccgggtggggtgcaggacccggaagggctgtggaaactggtcgcctccggtggcgacgccatcggtgaattccccgctgatcgtggttggcacctcgacgagctctacgatcccgacccggatcagcccggaacctgctacacccggcacggcggcttcctccacgacgccggcgagttcgacgcgggattcttcgacatcagcccccgtgaggcgctcgcgatggacccgcagcagcggctgctgctggaaatctcctgggagaccgtcgaatccgctgggatggacccgaggtccttgcgggggagccgcaccggggtgttcgcgggattgatgtacgagggctatgacaccggcgcccaccgggcaggagaaggtgtcgaaggctatctcggaaccggcaatgcgggaagcgtcgcctctggtcgggttgcgtatgcgttcgggttcgagggcccagcggtgacggtagacacggcgtgctcgtcgtcgttggtggcgctgcatttggcgtgtcagtcgttgcggcagggcgagtgtgatctggcgctggccggtggagtgacggtgatgtcgacgccggagaggttcgtggagttctcccgtcagcgtggtctcgcaccggatgggcggtgtaagtcgttcgcggcggctgcggatggaaccggttggggtgagggtgccggtttggtgttgctggagcggctgtcagacgccaggcggaacgggcatcgggtactggcggttgttcgtggtagcgcggtgaatcaggacggtgcgtcgaacggattgacggccccgaacgggctggcccaggagcgggtcattcagcaggtgctcacgagtgcggggctgtcggcgtccgatgtggacgctgtggaggcgcatggaacgggtacgcggcttggtgatccgatcgaggcgcaggctctgatagccgcctatggacaggatcgggaccgggaccggccgctgtggttggggtcggtcaagtccaacatcggtcatacgcaggcggctgcgggcgtcgctggtgtgatcaagatggtcatggcgatgcggcacggggagctgccgcgcacgttgcacgtggacgagccgaattcgcacgtggactggtcggctggtgcggtccgactcctgaccgagaacatccgctggccagggacgggtacgcgccgcgctggagtgtcgtcgttcggggtaagcggtaccaacgcacacgtcatcctcgaacacgacccgctcgccgtgaccgagaacgaggaagcagcgcagtccccagcacctgggatcgtgccctgggcgttgtccgggcggtcgtcgacggcgctgcgggcccaggccgaacggctgcgcgagctgtgcgagcagaccgatcccgaccccgtcgatgtcggtttctcactggccgccacgcgcacggcttgggagcaccgagcggtggtgcttggtcgggacagcgctacgttgcgctccgggcttggcgttgttgccagcggtgaaccagcggtcgatgtcgttgaggggagcgtcctggacggcgaggtcgtcttcgtcttccccggtcagggctggcagtgggccggtatggcagtcgacctgctggacgcttcgccgacgttcgcgcgccacatggacgagtgcgccaccgcgctgcggaggtacgtggactggtcgttggtcgacgtgctgcgcggagcggagaactccccaccgctggaccgggtggacgtgctccagcccgcgtccttcgcggtgatggtgtcgctcgccgaggtgtggcgttcctacggggtgaggccggcggccgtcgtcggccacagtcaaggcgaaatcgccgcggcctgcgcagccggggtgctgccgctggaggatgcggccaggcttgtcgcattgcgcagcagagcgttgaagggactttcggggcggggtggcatggcgtcgctggcctgccctgcggatgaggtcgcggcattgttcgcgggatcgggcggccgtctggaagttgcggcgatcaacggcccgcgatcggtcgtggtgtccggcgatctggaagcggtggacgaactgctggcagagtgcgctgaaaaggacatgcgtgcacgccgtatccccgtcgactacgcctcgcattcagcgcacgtggaggtggttcggagcccggtgctggcggccgccgccggggtgcgacaccgggacggccaggtgccgtggtggtcgacggtgatcggcgactgggtggatccggccaggctggacggcgagtattggtatcggaacctccggcagccggtccggttcgaacacgccgtgcagggcctggtcgagcggggattcggcctgttcatcgaaatgagtgcgcatccggtgctgaccacggcggtcgaggaaaccggtgcggagtcggagaccgccgtggccgcggtaggtaccttgcgacgtgactcgggcggcctccggaggttgttgcattcgctggccgaggcgtacgtgcgcggcgccaccgtggactgggccgtggcgttcgggggcgcgggccgacggctggacctgccgacctacccgttccagcgccagcggtactggctggacaagggagctgcctccgacgaggctcgtgcggtctcggacccggcggcgggctggttctggcaagccgtggcgcgccaagacctgaaaagcgtgtccgatgccctcgatctcgacgccgacgcaccgctgagcgcaacacttccagccctgtccgtctggcaccgtcaggaacgagaaagggtcttggcagacggttggcggtaccgagtcgactgggtacgggtggccccgcagccggtccggagaacgcgggaaacctggctcctggtcgttcccccgggcggcatcgaggaagcgctggtcgaacggctgacggatgcgttgaacacgcgagggatcagcaccctgcgcctcgacgtgccaccggcggcgaccagtggcgaactcgcaaccgaactccgcgccgcagccgacggtgacccggtgaaggcaatcctgtcgctcaccgcgttggacgagcgaccccaccccgaatgcaaggacgtcccgagcgggattgccttgctgctgaacctggtcaaggcgctcggtgaagccgacctcagaattcctctgtggaccatcacgcgtggtgcggtcaaggcaggccccgcagatcggctgctgcgcccgatgcaggcgcaagcatggggtctggggcgagtagccgcactcgaacaccccgagcgctggggtgggctgatcgacctgccggattcgctggacggcgacgtcctcacgaggctgggcgaagcgctcaccaacggcttggcggaagaccaactggcgattcgccagtcgggcgtgctggcccggcgactggtacccgccccggcgaatcagcccgctggacgtaagtggcgcccccgagggagcgcgctgatcacgggcggactcggcgcggtgggcgcacaggtggcgaggtggttggccgaaatcggagccgagcgaatcgtgctcaccagtcgacggggcaaccaagcagcaggcgccgccgagctggaagccgaactccgggcccttggagcgcaagtgtccatcgtggcttgcgacgtgaccgatcgtgccgagatgtccgcactactggccgagttcgacgtcaccgcggtgttccacgcggccggagtcggtcggctgctgccgttggcggagaccgaccagaacggcctggccgaaatatgcgcggcgaaggtccgcggcgctcaggtgctggacgaactgtgcgacagcaccgatctcgatgccttcgtcctgttctcctcgggtgccggggtatggggcgggggcggtcagggcgcttacggcgcggcgaacgcattcttggacacactcgccgaacaacgccgagcacgcggtctgccggcaacctcgatctcctggggcagttgggccggcggcggcatggccgacggcgcggcgggcgaacacctgcggcgacgcgggatacgtccgatgccggcggcgtcggccatcctggctctgcaggaagtacttgaccaggatgagacgtgcgtgtcgatcgctgatgtggactgggaccgattcgttcccacgttcgccgcgactcgcgccacccggttgttcgacgaagtgccggcggcgagaaaggcgatgcccgcgaatgggccggcagaaccaggcggctcgccgttcgcccgcaatctcgcggagctgccggaagcccaacgacgccacgaactggtggatctggtgtgcgcccaggtggcaaccgtgctcgggcacggcagtcgcgaggaagtccagcccgagcgggcgttccgcgcgctcgggttcgactccctcatggcggtggatctgcgcaatcgtttgaccaccgccaccgggttgcgcctgccgaccacaaccgtcttcgactacccgaatccggccgccttggccgctcacctgctcgaggagctggtgggtgatgtcgcgtcggctgcggtgaccgctgccagcgcgcccgcgagtgacgaaccgatcgcgatcgtcgcgatgagctgccggtttccgggtggcgcgcactcgccggaagacctgtggcggctggtcgccgccggcacggaggtgatcggcgagttcccctccgaccggggctgggatgcggaaggcctttacgatccggatgcttccaggcctggaacgacgtatgcgcggatggcgggattcctctacgacgccggtgagttcgatgccgacctgttcggcatcagcccacgtgaggcgttggcgatggatccgcagcagcggttggtgctcgaaatcgcctgggaagccctcgaacgggccggaatcgatccgttgtccttgaagggcagtggggtcggcacgtacatcggcgctggaagccgtgggtacgcgacggatgtgcggcagtttcccgaggaggcggagggctacctgctgacgggtacctcggccagtgtgctgtcgggtcgggtcgcgtattcgtttggtttcgagggtcctgcggtgacggtggatacggcttgttcgtcgtcgttggtggcgttgcatctggcgtgccagtcgttgcgttcgggcgagtgtgatctggcgttggccggtggtgtgaccgtgatgtcgacgccggagatgttcgtggagttctcccgtcagcgcggtttggcgccggatgggcggtgcaagtcgttcgcggagagcgcggacggcaccggctggggcgaaggcgcgggcctgttgttgctggagcggttgtcggacgcccaccggaatgggcatcgggtgttggcggtggttcgtgggtcagcggtgaatcaggacggcgcctcgaacggactggcggcgccgaacggtccgtcgcagcagcgggtgatcaaccaggcactcgcgaatgcggctctttcggcgtccgatgtggatgcggtggaggcacatggcaccgggaccaggctgggtgatccgatcgaggcgcaggcattgatcgcaacgtatgggcaggcccgggagcgggatcggcccttgtggctggggtcggtcaagtcgaacatcggtcatacgcaggccgcggcgggtgttgccggtgtgatcaagatggtgatggccatgcggcacgggcagctgcccgcctcgctgcacgcggatgagcccacgtcggaggtcgattggtcgtcgggggcggtccggctcctcgccgaacaggtaccttggccggagtctgaccgtgttcgtcgggtgggggtttcgtcgttcgggatcagcggcaccaacgcacatgtgatcctcgaacaagctacgaatgcgccagatagtacagcggagacggacaaaacagaatccggatctactgtcgatattccggtcgttccctggttggtgtcgggaaagacgacggattccctgcggggacaagccgaacgagtcttgtctcaggtcgagtcccggccggagcagcgttcgctggatgttgcctactcgcttgcttctggccgagccgcgctggatgaacgcgctgtcgtgctgggtgcggaccgcggtgagctggttgctggactggcggcgttggccgccggtcaggaggcttctggggtgatcagcggaactcgtgcttctgctcggttcgggttcgtgttctcggggcagggtggtcagtggttggggatgggcagagcgctctactcgaagtttccggtgttcgctgctgcgtttgatgaggcttgcgccgagttggaggcacatctgggggaagaccgccgggttcgggatgtggtcttcggttccgatgcgcagctgctggatcagacgctgtgggcgcagtcgggtctgttcgcgctgcaagccggcctcttggggctgctgggttcgtggggcgttcggccggatgtggtgatggggcattcggtcggggagttggccgccgcgtttgcggctggcgtgttgtcgttgcgggatgcggctcggttggtggccgcgcgcgcccggttgatgcaagccctgccctctgacggcgcgatgttggcggtggctgctggtgaagaccttgttcggccattgctggccggtcgggaggagtccgtgagcgtcgccgcgctcaatgcccccggttcggtggtgttgtcgggcgatcgggaggtgctggccagcatcgtcggccggctgaccgagctccgagtccggacgcggcgcttgcgggtctcccatgcttttcattcgcaccggatggacccgatgttgggcgagttcgcccagatcgccgagtctgcggagttcggtaagccaacgacaccgcttgtgtcgacgttgacgggtgagctcgacagagccgcggaaatgagcacaccagggtattgggtgcgccaggcgcgtgaacccgtccgtttcgccgacggtgtccaggccctggcagcgcagggcataggcacggtcgtcgagctcggcccggacggaacgctggcggcactggttcgggagtgtgcgaccgagtccgatcgggttgggcggatttcgtcgatcccactgatgcgcagggagcgggacgagacccgttcggtgatgacagccctggcgcatctccacacccgtggtggtgaggtggactggcaggcgtttttcgccggtaccggcgctaggcagctcgagttgccaacgtatgccttccaacgacagcactactggatcgagtccagtgcgcggccagcacgcgaccgcgcagacatcggcgaggtggcggaacagttctggaccgcggttgaccaaggcgatctggcaacgttggtcgccgctctggatcttggggcggacgacgacacatgcgcatcgttgagcgatgtattgccggcgttgtcctcctggcgaagcggactccgcaaccgttcgctcgtcgattcctgccggtaccgaatcagttggcattcctctcgggaggtgccggccccgaagatttccggtacctggctgttggtcgtgcccggtgctgcggatgacggattggtcacggctttgacgagttcactggtcggaggcggcgccgaggtcgtccggatcggcctgtccgaagaggacccgcaccgcgaggacgtcgcacagcggctggccaatgcgctgacggatgccggtcaactcggtggcgtgctttcgctgttggggctcgatgaatcgcctgctccgggattctcctgcttgccaactggtttcgcgctgactgtgcagcttctgcgggccttgcggaaggccgacgtcgaggcgcctttttgggcggtgacgcgcggcggcgtcgcgttggaagatgtacgcgtgtctccggagcaggccctggtctgggggctgctgcgtgtcgcgggactggagcacccggagttctggggtggcttgatcgacctgccatcggactgggacgaccgattgggtgcccggttggcgggtgtgttggcggatggtggcgaggatcaagtcgccattcgccgtggtggtgtgttcgtgcggcggttggaacgcgctggtgcgtcgggtgccgggtcggtgtggcgtcctcgggggacggtgttggtgacgggtggtacgggcggtttgggggcgcatgttgcccggtggttggccggtgccggggctgagcacgtggtgttgaccagccgtcgaggagcggacgctccgggcgctggggaattgcgggcggagctggaggcgctgggtgctcgggtgtcgattgtgccctgcgacgtggctgatcgtgacgcagtggctggagtgttggcagggatcggtggggagtgtccgctgactgcggtggtacacgccgccggggtcggcgaggcgggcgacgtagtggagatgggtttggcggattttgcagcggtgttgtcggcgaaggtgcgtggtgcggcgaatctggacgagttgctggccgactcggagctggatgcgtttgtgatgttctcctcggtgtcgggggtgtggggagccggcggacagggtgcgtatgcggctgcgaacgcctacttggatgcgttggccgagcagcgtcgggcgaggggattggtcgggaccgcggttgcgtggggaccgtgggccggtgacggcatggccgccggcgaaaccggcgcacagctgcaccggatgggcctggcgtcgatggaaccgagcgcggcgctgctggcacttcagggtgcattggaccgcgatgagacctccctcgtcgtggccgatgtcgattgggcacggttcgccccagccttcacctcggcacgtcgacgcccgctgctggacaccatcgacgaggcccgagccgcattggaaaccaccggcgaacaagcgggcacaggcaaacccgttgagctgacgcaacgcctggccggactgtcgcggaaggaacgcgacgatgcggtattggatctggtgcgggcggagacggcggctgtgctgggacgcgacgatgccacggccctggcgccatcgcggccgttccaggaactcggattcgactccttgatggcggtggagctgcgcaaccggctgaacaccgccaccgggatccagctgcccgccagcacgattttcgactaccccaatgccgagtcgctgtcgcgtcacctctgcgccgagcttttcccaacggagactaccgtggactcggcccttgccgagctcgatcgaatcgagcagcagctctcgatgctcaccggcgaagcgcgggcacgggaccgaatcgcgacacgactgcgagccctccacgagaagtggaacagcgcagctgaagtaccgaccggagccgatgtcctgagcacgctcgattcggcgacgcacgacgagatattcgagttcatcgacaacgagctcgacctgtcctga

SEQ ID NO: 46 - protein, 3170 aa, Saccharopolyspora spinosa
MSNEEKLREYLRRALVDLHQARERLHEAESGEREPIAIVAMGCRYPGGVQDPEGLWKLVASGGDAIGEFPADRGWHLDELYDPDPDQPGTCYTRHGGFLHDAGEFDAGFFDISPREALAMDPQQRLLLEISWETVESAGMDPRSLRGSRTGVFAGLMYEGYDTGAHRAGEGVEGYLGTGNAGSVASGRVAYAFGFEGPAVTVDTACSSSLVALHLACQSLRQGECDLALAGGVTVMSTPERFVEFSRQRGLAPDGRCKSFAAAADGTGWGEGAGLVLLERLSDARRNGHRVLAVVRGSAVNQDGASNGLTAPNGLAQERVIQQVLTSAGLSASDVDAVEAHGTGTRLGDPIEAQALIAAYGQDRDRDRPLWLGSVKSNIGHTQAAAGVAGVIKMVMAMRHGELPRTLHVDEPNSHVDWSAGAVRLLTENIRWPGTGTRRAGVSSFGVSGTNAHVILEHDPLAVTENEEAAQSPAPGIVPWALSGRSSTALRAQAERLRELCEQTDPDPVDVGFSLAATRTAWEHRAVVLGRDSATLRSGLGVVASGEPAVDVVEGSVLDGEVVFVFPGQGWQWAGMAVDLLDASPTFARHMDECATALRRYVDWSLVDVLRGAENSPPLDRVDVLQPASFAVMVSLAEVWRSYGVRPAAVVGHSQGEIAAACAAGVLPLEDAARLVALRSRALKGLSGRGGMASLACPADEVAALFAGSGGRLEVAAINGPRSVVVSGDLEAVDELLAECAEKDMRARRIPVDYASHSAHVEVVRSPVLAAAAGVRHRDGQVPWWSTVIGDWVDPARLDGEYWYRNLRQPVRFEHAVQGLVERGFGLFIEMSAHPVLTTAVEETGAESETAVAAVGTLRRDSGGLRRLLHSLAEAYVRGATVDWAVAFGGAGRRLDLPTYPFQRQRYWLDKGAASDEARAVSDPAAGWFWQAVARQDLKSVSDALDLDADAPLSATLPALSVWHRQERERVLADGWRYRVDWVRVAPQPVRRTRETWLLVVPPGGIEEALVERLTDALNTRGISTLRLDVPPAATSGELATELRAAADGDPVKAILSLTALDERPHPECKDVPSGIALLLNLVKALGEADLRIPLWTITRGAVKAGPADRLLRPMQAQAWGLGRVAALEHPERWGGLIDLPDSLDGDVLTRLGEALTNGLAEDQLAIRQSGVLARRLVPAPANQPAGRKWRPRGSALITGGLGAVGAQVARWLAEIGAERIVLTSRRGNQAAGAAELEAELRALGAQVSIVACDVTDRAEMSALLAEFDVTAVFHAAGVGRLLPLAETDQNGLAEICAAKVRGAQVLDELCDSTDLDAFVLFSSGAGVWGGGGQGAYGAANAFLDTLAEQRRARGLPATSISWGSWAGGGMADGAAGEHLRRRGIRPMPAASAILALQEVLDQDETCVSIADVDWDRFVPTFAATRATRLFDEVPAARKAMPANGPAEPGGSPFARNLAELPEAQRRHELVDLVCAQVATVLGHGSREEVQPERAFRALGFDSLMAVDLRNRLTTATGLRLPTTTVFDYPNPAALAAHLLEELVGDVASAAVTAASAPASDEPIAIVAMSCRFPGGAHSPEDLWRLVAAGTEVIGEFPSDRGWDAEGLYDPDASRPGTTYARMAGFLYDAGEFDADLFGISPREALAMDPQQRLVLEIAWEALERAGIDPLSLKGSGVGTYIGAGSRGYATDVRQFPEEAEGYLLTGTSASVLSGRVAYSFGFEGPAVTVDTACSSSLVALHLACQSLRSGECDLALAGGVTVMSTPEMFVEFSRQRGLAPDGRCKSFAESADGTGWGEGAGLLLLERLSDAHRNGHRVLAVVRGSAVNQDGASNGLAAPNGPSQQRVINQALANAALSASDVDAVEAHGTGTRLGDPIEAQALIATYGQARERDRPLWLGSVKSNIGHTQAAAGVAGVIKMVMAMRHGQLPASLHADEPTSEVDWSSGAVRLLAEQVPWPESDRVRRVGVSSFGISGTNAHVILEQATNAPDSTAETDKTESGSTVDIPVVPWLVSGKTTDSLRGQAERVLSQVESRPEQRSLDVAYSLASGRAALDERAVVLGADRGELVAGLAALAAGQEASGVISGTRASARFGFVFSGQGGQWLGMGRALYSKFPVFAAAFDEACAELEAHLGEDRRVRDVVFGSDAQLLDQTLWAQSGLFALQAGLLGLLGSWGVRPDVVMGHSVGELAAAFAAGVLSLRDAARLVAARARLMQALPSDGAMLAVAAGEDLVRPLLAGREESVSVAALNAPGSVVLSGDREVLASIVGRLTELRVRTRRLRVSHAFHSHRMDPMLGEFAQIAESAEFGKPTTPLVSTLTGELDRAAEMSTPGYWVRQAREPVRFADGVQALAAQGIGTVVELGPDGTLAALVRECATESDRVGRISSIPLMRRERDETRSVMTALAHLHTRGGEVDWQAFFAGTGARQLELPTYAFQRQHYWIESSARPARDRADIGEVAEQFWTAVDQGDLATLVAALDLGADDDTCASLSDVLPALSSWRSGLRNRSLVDSCRYRISWHSSREVPAPKISGTWLLVVPGAADDGLVTALTSSLVGGGAEVVRIGLSEEDPHREDVAQRLANALTDAGQLGGVLSLLGLDESPAPGFSCLPTGFALTVQLLRALRKADVEAPFWAVTRGGVALEDVRVSPEQALVWGLLRVAGLEHPEFWGGLIDLPSDWDDRLGARLAGVLADGGEDQVAIRRGGVFVRRLERAGASGAGSVWRPRGTVLVTGGTGGLGAHVARWLAGAGAEHVVLTSRRGADAPGAGELRAELEALGARVSIVPCDVADRDAVAGVLAGIGGECPLTAVVHAAGVGEAGDVVEMGLADFAAVLSAKVRGAANLDELLADSELDAFVMFSSVSGVWGAGGQGAYAAANAYLDALAEQRRARGLVGTAVAWGPWAGDGMAAGETGAQLHRMGLASMEPSAALLALQGALDRDETSLVVADVDWARFAPAFTSARRRPLLDTIDEARAALETTGEQAGTGKPVELTQRLAGLSRKERDDAVLDLVRAETAAVLGRDDATALAPSRPFQELGFDSLMAVELRNRLNTATGIQLPASTIFDYPNAESLSRHLCAELFPTETTVDSALAELDRIEQQLSMLTGEARARDRIATRLRALHEKWNSAAEVPTGADVLSTLDSATHDEIFEFIDNELDLS

SEQ ID NO: 47 - DNA, 14775 bp, Saccharopolyspora spinosa
  CDS (1)..(14772): ORF21; polyketide synthase
atggccaatgaagaaaagctcttcggctatctgaagaaggtaactgcggacctgcatcagacccggcagcgcctgctcgcggccgagagccggagtcaggagccgatcgcgatcgtctcggcgagctgccgactgcccggcggcgtcgactctcccgaagcgctctggcaactcgtgcgcactggcaccgacgccatctcggagttccccgccgaccggggctgggatctcggccggttgtacgatcccgacccgaaccaccagggaacgtcgtacacgcgggccggcggtttcctcgcaggagcgggcgatttcgaccccgccatgttcgggatttcgccgcgtgaggcgttggcgatggacccgcagcaacggttgttgctggagctgtcctgggaggccctcgaacgggcgggcatagacccgacatccctgcgcggcagcaagaccggtgtcttcggtggtgtcacgccccaggagtacgggccgtccttgcaggagatgagccgaaacgctgggggttttggactcaccgggcggatggtgagtgtggcgtcgggtcgggttgcgtattcgtttggttttgagggtcctgcggtgacggtggatacggcgtgttcgtcgtcgttggtggccctgcatttggcgtgtcagtcgttgcgttccggcgaatgcgatctcgcgctggccggcggtgtgacggtgatggcgacaccggcgacgttcgtggagttctcccgtcagcgtggtttggctccggacgggcggtgcaagtcgttcgcggctgccgcggatggcaccgggtggggtgagggtgccggtctggtgttgctggagcggttgtcggatgcgcggcggaatgggcacgaggttctggcggtggtgcggggtagcgcggtgaaccaggacggcgcgtcgaatggtttgactgcgccgaatggtccgtcgcagcagcgggtgatcacccaggcgttggcgagtgcggggctgtcggtttccgatgtggatgcggtcgaggcacatgggaccgggaccacgttgggtgatccgatcgaggcacaggccctgatcgccacgtacgggcagggccgggagaaggatcggccgttgtggttggggtcggtcaagtccaacatcggtcacacgcaggcggccgctggcgttgccggcgtcatcaagatggtcttggcgatgcggcacgggcagctgcccgccacgttgcatgtggatgagcccacgtcggcggtggactggtcggcgggttcggtccggcttctcacggagaacacgccctggccggacagtggtcgtccttgccgggtgggggtgtcgtcgttcgggatcagcggcaccaacgcacatgtgattctcgaacagtctccagtcgagcagggcgaaccggccgggccggtcgaaggcgagcgggaaccggatgtagccgtccccgtggtgccttgggtgctgtcgggtaagacaccggaggctgcgcgggcgcaggccgaacgggtgcattcgcatatcgaggaccggccggggctgtcgccggtggatgtggcgtattcgctaggaatgacacgcgcggcgctggatgaacgcgcagtggtgttgggctcggaccgtgccgcgctcctgaccgggttgagggcattcgccgacggctgcgatgcgcccgaagtggtttcggggtctgtggggcttggtggccgcgtcgggttcgtgttctcgggtcagggtggtcagtggccggggatgggccgggggctctactcggtgtttccggtgttcgccgacgcgttcgacgaggcttgcgcggagttggatgcacacctgggccaggaactgcgggttcgggatgtggtgttcggttcgcaagcgtggttgctggatcggacggtgtgggcgcagtcgggtttgttcgcgttgcagattggcttgctgcggctgctgggttcgtggggtgttcggccggatgtggtgttggggcactcggtgggtgagctggctgcggtgcatgcggctggtgtgttgtcgttgtcggaggccgcgcggttggtggcgggtcgcgcccggttgatgcaggcgttgccttctggtggtgccatgctcgcggtcgctacgggtgagtttcaggtcgatcctctgctggatggggtgcgggaccggatcggtatcgcggcggtgaatggcccggaatcggttgtgctctctggtgaccgcgagctgctcaccgagatcgctgatcggttgcacgatcaggggtgccggacccggtggttgcgggtgtcgcatgctttccattcgccccatatggagccgatgctggaggagttcgcccagatctcccgaggccgcgaatatcacgcaccggaactgccgatcatctcgaccctgatcggtgagctggacggtggtcgagtgatgggcactcccgagtactgggtgcgtcaggtgcgtgagcccgtccgtttcgccgagggtgtccaggcgcttgtcggtcagggtgtcggcacgattgtcgaattgggtccggacggggcgttgtcgacgttggtcgaggagtgtgtggcggaatccgggcgggtggccgggatcccgctgatgcgcaaggaccgcgacgaggcgcgaaccgtgctggcagctttggcgcagatccacacccgtggtggtgaggtggactggcggtcgtttttcgccggtaccggggcgaagcaagtcgacctgcccacctacgccttccagcggcagcggtactggctggcatccaccgggcgtgcgggtgacgtgaccgccgccggattggccgaggcggaccatccgctgctcggtgcggtggttgcgttggcagacggcgaaggtgtggtgctgaccggtcggttgacagcgggttcgcatccgtggttgtccgatcaccgggtgctgggcgaaatcgtcgtccccggcaccgcgatcgtcgagctggtgtggcacgtcggcgagcgcctcggttgtggccgggtggaagaactggctttggaagcgcccctgatcctgccggatcatggagcggtccaggttcaggtgctggtgggaccgcccggggaatccggagcccggtcggtggcgctctactcctgtcctggcgaggcgatcgaacccgagtggaagaagcacgcgacgggcgtgcttctcccacccgtggccgccgagaaccatgagctgaccgcatggcccccggagaatgcgaccgaaatcgatgcagacggggtctacgcattccttgaagggcacggtttcgcgtacggaccggcctttagatgtctgcgcggtgcctggcgacgaggcggggaggtgttcgccgaagtcgcattgccggatgacatgcaggcgggggtcgatcgattcggcgtccaccccgcgttgctggacgcggttctgcatgccgccgcagccgagacgtcggtggtccagagcgaagcgcgggtgccgttctcgtggcgtggggtggaacttcgcgccactgaaagcgcggtggtgcgggcgcgcctctcgttgacttcggatgacgaactgtcgttggtcgcagtggacccggctggccgattcgtggccacggttgattcgctggtgacccgaccgatctcccggcagcaggtgaggtctggcgcgatcggtgattgcctgttcgaggtggagtggcaccggaaggcgttgttgggaacaaccgccggcgacgaccttgccatcgtcggtgacggtcccagttggccggaatcggtgcgcgcaaccgcacggttcgcgaccctggatgagttccgtgcggccgtggactcggacgttcctgccccgggttcggtgttggtcgcagctatgtcggccgaagaggtcgagggtggatccctgccgtcgcgcgcccaagagtcgacctccgatctgctggctctcgtgcagtcgtggcttgcggacgagcggttcgccgaatcccagctcgtggtcgtcacgcgtgcagcggtgtcggccgactcggattcggacgtcgcggacctggtgggtgcgtcgtcgtgggggttgttgagttcagcccagtcggagaacccgggtcgcttcgtgctggtggacgtggacggcacacctgagtcgtggcaggcgttgccggccgccgtgcgagcaggagaaccgcagctggcacttcggcgcggcgtggcgctggtgcctcggttggcgcgactcacggtgcgcgaggagggctcctccccgcaactcgacacggacgggaccgtcctcatcacgggtggcaccggtgcgttggggggagtggttgcccgtcacctggtggaggagcacgggattcggcgtttggtgttggcaggccggcgtggctggaatgcgcctggagtccacgagttggtggatgagctggcgcgcgcgggcgccgtggttgaggtggtggcttgcgatgtggctgaccgcaccgatctggagcacgtgctggccgccattccggtcgactggccgctgcgggggatcgtgcataccgctggggtgctggccgacggagtgatcgggtccttgtcggcggcggatgtgggcacggtgtttgccccgaaggtgacgggggcatggcatctgcacgagttgacccgcgatctggatctgtcgttcttcgttcttttctcttccttctccgggattgcgggtgccgcagggcaggccaactacgcggcggcgaacacgttcctggatgcattggcgcgttatcgccgggcgcgtgggctgcctgggttgtcgttggcgtggggactgtgggcgcaacccagcggtatgacgagtggcttggacgcggcgtcggtggagcggttggcgcggacgggcatcgcagaactttccacggaggatggactccgcctgttcgatgccgcgttcgcgaaggaccgggcttgcgtcgttgccgctcgattggacagggcgctgctggtcgggaacggacgatcgcacgcgattccggcgctgttgagcgcgttggttcctgttcgcggcggtgtggcgaggaaaacagccaattctcaggccgcggatgaggacgcactgttgggtttggtgcgggagcacgtttcggccgtgctgggttattcgggtgcggtcgaggttgggggcgaccgtgctttccgtgatctgggttttgattcgttgtctggcgtggagttgcggaaccgccttgccggggtgctgggggtgcggttgccggcgactgcggtgttcgactatccgacgccgcgggcgctggcgcgtttcctgcatcaggaactggcaggcgaggtcgcgtccacgtcgacgccggtgaccagggcagcgagtgccgaagaggatcttgttgcgattgtcgggatgggatgtcgttttccgggtggggtgtcgtcgccggaggagctttggcggctggtggccggcggcgtggatgcggtggctgggttcccagacgatcgcggctgggatctcgcggcgttgtacgatcctgatcccgatcgtctcgggacctcgtatgtgtgtgagggcgggtttctgcgggacgcggcggagttcgatgctgacatgttcggcatcagcccgcgtgaggcgttggcgatggatccgcagcagcggttgctgctggaggtcgcctgggaaaccttggagcgggctgggatcgatccgttctcgttgcacggcagccggaccggtgtgttcgcgggcttgatgtaccacgactatggggcccgattcattaccagagcaccggagggcttcgaagggcacctcgggacgggcaatgcggggagcgtgctgtcgggtcgggttgcgtattcgtttggtttcgagggtcctgcggtgacggtggatacggcgtgttcgtcgtcgttggtggcgttacacctggcgggtcaagcactgcgggccggtgagtgcgaattcgcccttgccggtggcgtcacggtgatgtcgacgccgacgacgttcgtggagttctcccgtcaacggggtctggctccggatgggcggtgcaagtcgttcgcggcggccgcggatggcaccgggtggggcgagggtgccggtctggtgttgctggagcggttgtcggatgcccggcgcaatgggcacgaggttctggcggtggtgcggggtagcgcggtgaaccaggacggcgcgtcgaatggcttgactgcgccaaatggtccgtcacagcaaagggtgatcacccaggcactcacgagtgccgggctgtccgtgtccgacgtggatgctgtggaggcgcatgggacgggcacgcggcttggtgatccgatcgaggcgcaggcgttgatcgctacgtacggccgggatcgtgatcccggtcggccgttgtggctggggtcggtgaagtcgaatattggtcacacccaggcggcggcgggtgtcgctggtgtgatcaagatggtgatggcgatgcggcagggggagctgccgcgcacgttgcacgtggacgagccctccgcgcaggtggactggtctgcgggcacggtccaactcctcacggagaacacgccctggcccgacagcggtcgtcttcgccgggcgggcgtgtcatcgttcgggatcagtggcaccaacgcgcacctgatccttgaacaacctccgcgagagtcgcagcgctcaacagagccggattcgggttctgtccgcgattttccggtggtgccgtggatggtgtcgggcaaaacacccgaagcgctatccgcccaggcagatgcattgatgtcctacttgagcaatcgcgttgatgcttccccgcgagatatcggttattcgcttgcggtgacccgtccggcgttggaccaccgcgctgtcgtgctgggtgcggatcgtgccgcgttgctgccgggcttgaaagcgctggccgttagtaatgacgctgccgaggtgatcaccggcactcgtgccgctgggccggtcggattcgtgttctccggtcaaggtggtcagtggcccgggatgggaagcgggctccactcggcgtttccggtgttcgccgacgcgtttgacgaagcctgctgcgagctggatgcgcatctcgggcagatggcccggctacgagatgtgttgtccggttcggatacgcaacttctggaccagaccttgtgggcgcagccgggcctgttcgcgttgcaagtcggactctgggagttgttgggttcgtggggtgtccggcccgctgtggtgctgggccactcggtcggtgagctggcggcggcgttcgcggctggagtgttgtcgttgcgggatgcggctcggctggtggcgggccgtgcccggttgatgcaagccctgccaactggcggtgccatgctcgctgcggctgctggagaggagcagctgcgcccgttgctggccgactgcggtgatcgtgtggggatcgccgcggtcaacgctcccgggtcggtggtgctctccggtgatcgggatgtgctcgatgacattgccggtcggctggacgggcaagggatccggtccaggtggttgcgggtttcgcatgcgtttcattcgcatcggatggatccgatgctggcggagttcaccgaaatcgcccggagcgtggactaccggtcgtcagggctgccgatcgtgtcgacgttgacgggtgagctcgatgaggtcggcatgccggctacgccggagtattgggtgcgccaggtgcgagaacccgtccgcttcgccgacggtgttgctgcgctcgcggctcacggtgtgagcaccgtcgtcgaggtcggtccggatggggtgttgtcggcgctggtgcaggagtgcgcggccggatccgatcagggcggacgggtggccgcggttccgctcatgcgcagcaatcgcgacgaggcgcacacggtgacaacggcattggcgcagatccatgtgcgtggtgctgaggtggactggcggtcgtttttcgccggtaccggggcaaagcaggtcgagctgcccacgtatgccttccaacgacagcggtactggcttgactcaccatccgaaccggtcgggcaatccgccgatcccgcgcgccagtcgggcttctgggaactcgtcgagcaggaagatgtcagcgcgctcagcgccgctctgcacattaccggcgatcacgacgtgcaggcgtccctggaatcggtggttccggtcctctcctcctggcatcgccggatccgcaacgaatccctggtgcaccagtggcggtaccggatttcctggcatgagcgggcagatttgccagacccctcgttgtcggggacatggctcgtcgtcgtgccggaggggtggtcggcgagtcggcaagttctgcgtttcaacgagatgttcgaggaacggggttgcccggcagttctgttcgagctcgccgggcacgacgaggaagccctggcgcaacgattccgctcgttgcctgttgcgtcagggggaataagcggcgtgttgtccttgctggcgctggatgaatcgccgtcctcgccgaacgctgctttgccgaatggcgcgctgaactcgttggtactgctgcgagctctgcgggccgcggatgtgtcggcgccattgtggttggcgacgtgtggtggtgtcgcggtcggggatgtgccggtgaacccggggcaggcgctggtgtggggactgggtcgcgtcgtcggtctggagcatccggcctggtggggtggcctggtcgacgtgccgtgcttgctcgatgaggacgctcgagaacgcttgtcggtcgtgttggcaggtcttggcgaggacgagatcgcggtacgtcccggtggtgtgttcgtgcggcggttggaacgcgctggtgcggcgtcgggtgccgggtcggtgtggcgtcctcgggggacggtgttggtgacgggtggtacgggcggtttgggggcgcatgttgcccggtggttggcgggtgccggggctgagcatgtggtgttgaccagccgtcgaggcgcggcggctccgggcgctggagatttgcgggcggagctggaggcgctgggcgctcgggtttcgatcacggcctgcgacgtggccgatcgtgacgctttggccgaagtgttggcgaccattccggatgattgcccgctgaccgcggtgatgcatgcggcgggggtcgttgaagtcggcgacgtggcgtcgatgtgtttgaccgacttcgttggggtgctgtcggcgaaggcaggtggtgcggcgaatctcgatgagttgctcgccgatgtcgagctggatgccttcgtgctgttctcatccgtctcgggtgtgtggggtgctggcgggcagggcgcttatgcggcggcgaatgcctacttggatgcgttggcgcagcagcgtcgggcaagggggttggtggggactgcggttgcgtggggcccgtgggccggtgacggaatggccgcaggtgaaggcggtgcacagctgcgccgggccggcctggtgccaatggctgcggatcgggcgttgctggcacttcagggcgcattggatcgtgacgagacatccctggtcgtggccgatatggcgtgggagaggttcgccccggtgttcgccatgtcccgtcggcgtccgctgctcgacgagctgcccgaagcacagcaggcgttggcggatgcggagaacaccactgatgctgcggactcggccgtcccgctaccgcggctcgcgggcatggcagccgccgaacgccgccgcgcgatgctggacctggtgctggcggaggcctcgattgtgttgggacacaacgggtctgacccagttggtcccgaccgggcgttccaggagctcggatttgattcgctgatggccgtcgaactgcgcaacaggttgggcgaggcaacaggattgagtctgccggccacgttgatcttcgattatccgagcccatccgcgctggctgagcagctggtcggcgagctggtgggagcgcagcccgcgaccaccgtcgtggccggggccgatccagtggatgatccggttgtcgtggtcgcgatgggatgccggtatccgggcgacgtctgctcgcccgaggagctgtggcagctggtttctgcgggacgtgatgcggtatcgacgttccccgtcgatcggggttgggactgcaacacgttgttcgacccggatccggatcgggcaggcagtacctatgtgcgagaaggtgccttcctgaccggtgctgatcggttcgacgccgggttcttcggcatcagccctcgcgaggcgcgcgcaatggatccgcagcagaggttgttgctcgaagtggcgtgggaggttttcgaacgagcaggaatcgctccgctgtcgttgcggggtagcaggaccggtgtgttcgcggggaccaatgggcaggaccacggtgcgaaagtggctgccgcgccggaggcggcgggtcacctcctgaccggaaacgccgcgagtgtcctggccggccggctttcctacacgttcggccttgaggggcctgcggtggcggtggataccgcgtgttcgtcgtcgttggtggcgttgcatttggcgtgccagtcgctgcgttcgggtgagtgtgatatggcgttggcaggtggtgtgacggtgatgtcgacacccctggctttcctcgagttctctcgtcagcgcggtttggcgccagatggtcggtgcaagtcgtttgcggccgctgcggatggcaccgggtggggtgagggtgccggcctggtgttgctggagcggttgtcggatgctcgtcggaatggtcaccgggtgttggccgtggttcgcgggtctgcggtgaatcaggatggtgcgtcgaatggcctgactgcgccgaatggtccgtcgcagcagcgggtgattcggcaggccctcgcgaatgcggggctgtcggcgtccgatgtggatgtcgtggaggcgcacgggaccggtaccgggctcggggatccgatcgaggcgcaggcgctgatcgcgacatatgggcaggagcgggatcctgagcgggccctgtggctggggtcgatcaagtccaacatcggccacacgcaggcggcggccggtgtggcgggggtcatcaagatggtgcaggccatgcggcacggggagttgcctgcgacgttgcacgtggacaagcccactccacaggtggactggtctgccggggccgttcggctcctcaccgggaacacgccctggcccgagagcggccgtcctcgtcgagcgggggtgtcgtcgttcgggatcagcggcaccaacgcacacctcatcctcgaacaaccaccgtcggaaccagcggagatcgaccaatcggatcggcgggtcactgcgcatccagcggtgatcccgtggatgttgtcggctaggagtctcgcagcgctgcaggcccaagcggctgcgctgcaggcccggctggaccggggtcctggcgcttctccgctggatttggggtattcactcgcgaccactcgttctgtgctggacgaacgcgccgtcgtgtggggtgccgatcgggaggcactgctgtccaggctggcagcgctcgccgatggccggacggcgccgggggtgataacgggctctgcgaattccggtggccgcatcggattcgttttttccggtcagggcagtcagtggctggggatgggaaaggcgttgtgcgcggctttcccggcgttcgcggacgccttcgaggaagcctgcgacgcgctaagcgcacacctgggcgcggacgttcggggtgtgctgttcggtgctgatgagcagatgctcgaccggacgctgtgggcgcagtcggggatcttcgcggttcaagtcggcctcctgggattgctgaggtcgtggggcgtgcggccggccgcggtgctggggcactcggtcggcgagttggctgcggcgcacgcggctggtgtgttgtccttgccggacgctgcacggttggttgcggctcgggcccacctgatgcaggcattgcccaccggcggcgcaatgctcgcggtcgccaccagcgaggcggcggtcggaccgctgctttccggggtgtgcgatcgggtcagcatcgctgcgatcaacggccccgagtcggtagtgctctccggcgaccgcgatgtgctcgtggagctcgcaggcgaattcgatgcccgagggcttaggaccaaatggttgcgggtctcccatgctttccactcgcaccggatggaaccgattctggacgagtacgcggaaaccgccaggtgcgtcgagttcggtgaaccggtggtgccgatcgtctccgccgcgaccggtgcgctggacaccaccggactgatgtgcgcggccgactactggacgcgccaagtgcgtgatcctgtccgcttcggagacggtgtccgggcgctcgtcggccaaggcgtggacacgatcgtcgagttcggcccggacggggcgttgtcggccctggtcgagcagtgcttggccgggtccgaccaggctgggagggtggcggcgatcccgctgatgcgcagggaccgcgatgaggtcgagaccgcggtggcggccctggcgcacgtgcacgtccgcggtggtgcggtggactggtcggcttgcttcgccggcaccggcgcccgcaccgtcgagttgcccacctacgccttccaacgccagcggtactggctggccgggcaagcggacgggcgcggcggcgatgtggttgccgacccggtcgacgcgcgcttctgggagttggtcgagcgcgccgatccggaaccgttggtggatgaactctgcatcgaccgggaccagcccttccgggaggtgctgcccgttctggcttcctggcgcgagaaacaacgccaggaggccctcgcggattcctggcgctaccaggtgcgctggaggtccgtcgaggtgccgtccgcagccgccctccggggcgtgtggctggtggtgcttccagctgacgtgccccgagatcaaccggcggtcgtcatcgacgcgctgatcgcgcgcggcgccgaggtcgcggtcctggaattgaccgagcaggacctccaacgcagtgcgcttgtggacaaggtgcgcgccgtcattgcggaccgcaccgaggtgacgggtgtgttgtctctgttggcgatggacggcatgccctgcgcggcgcatccgcacctgtcccgtggtgtcgccgctaccgtgatcctgacgcaggtgttgggcgatgcgggtgtttccgccccgctgtggctggccacgaccggtggcgtcgaggccgggaccgaggacggtccggccgatccggaccacggcttgatctgggggctcggcagggtcgtcggccttgaacatccgcagtggtggggtggcctgatcgaccttccggagacactggacgagacgtcccggaacgggttggtggccgcactcgccgggacggcggccgaagatcagctcgccgtgcgttcatccgggttgttcgttcgcagagtggtgcgcgcagcgcggaacccccggtcagagacatggcgtagccggggaacggtcctcatcacgggcggaacaggcgcgctcggtgccgaggtcgcacgatggctggcccggcggggagctgagcacctggtgttgatcagtcgccgcggcccggaagctcccggcgcagcggacctaggggccgagctgactgaactcggcgtgaaagtcacagtcttggcctgcgatgtgacggaccgcgacgagctggcggcggtgctggcggccgttcccacggagtatccgctgtcggcggtcgtgcacaccgccggcgtcgggacgcctgcgaacctggccgagacgaccttggcgcagttcgccgacgtgttgtcggccaaggtcgtcggcgcggcgaacctggaccggctgcttggcgggcaaccgttggacgccttcgtgctgttctcctcgatctcgggagtttggggagccggcggccaaggagcctattcggccgccaatgcgtatctcgatgcccttgccgagcgccgacgggcttgcgggcggccggcgacgtgcatcgcctggggtccgtgggcgggtgcgggcatggccgttcaggaaggtaacgaggcgcatctccgccgaaggggcctggtaccgatggaaccgcagtcggccctcttcgcgctgcaacaggccctgtcccaacgagaaaccgccatcaccgtcgcagatgtggactgggagcgattcgccgcctctttcaccgcggcccgcccgcgaccactgttggaagagatcgtggatctacggcccgacaccgagaccgaggagaagcacggtgccggcgagctggggcagcagctggccgcactgccgcccgctgagcgcggacacctgctgctggaggtggtgctggcggaaaccgccagcaccctggggcacgattcggcggaggctgtgcaacccgatcggaccttcgccgaactgggcttcgattcgctgaccgcggtagagctgcgcaacaggttgaacgcggtgaccgggcttcgcctgccgccgacgctggttttcgaccacccgacgccgctggcgttgtccgaacagttggttccggccctggtcgcggagccggacaacggcatcgaatcgctgctcgccgagctcgacaggctggataccacgttggcgcaagggccttcgatcccactggaagaccaggccaaggtggcggagcgcttgcacgcactcctcgccaagtgggacggggcgcgtgacggcacggccagagcgacgtcaccccaatcgctgacggcggccacggacgacgaaatcttcgacctcatcgaccggaagttccggcgctga

SEQ ID NO: 48 - protein, 4924 aa, Saccharopolyspora spinosa
MANEEKLFGYLKKVTADLHQTRQRLLAAESRSQEPIAIVSASCRLPGGVDSPEALWQLVRTGTDAISEFPADRGWDLGRLYDPDPNHQGTSYTRAGGFLAGAGDFDPAMFGISPREALAMDPQQRLLLELSWEALERAGIDPTSLRGSKTGVFGGVTPQEYGPSLQEMSRNAGGFGLTGRMVSVASGRVAYSFGFEGPAVTVDTACSSSLVALHLACQSLRSGECDLALAGGVTVMATPATFVEFSRQRGLAPDGRCKSFAAAADGTGWGEGAGLVLLERLSDARRNGHEVLAVVRGSAVNQDGASNGLTAPNGPSQQRVITQALASAGLSVSDVDAVEAHGTGTTLGDPIEAQALIATYGQGREKDRPLWLGSVKSNIGHTQAAAGVAGVIKMVLAMRHGQLPATLHVDEPTSAVDWSAGSVRLLTENTPWPDSGRPCRVGVSSFGISGTNAHVILEQSPVEQGEPAGPVEGEREPDVAVPVVPWVLSGKTPEAARAQAERVHSHIEDRPGLSPVDVAYSLGMTRAALDERAVVLGSDRAALLTGLRAFADGCDAPEVVSGSVGLGGRVGFVFSGQGGQWPGMGRGLYSVFPVFADAFDEACAELDAHLGQELRVRDVVFGSQAWLLDRTVWAQSGLFALQIGLLRLLGSWGVRPDVVLGHSVGELAAVHAAGVLSLSEAARLVAGRARLMQALPSGGAMLAVATGEFQVDPLLDGVRDRIGIAAVNGPESVVLSGDRELLTEIADRLHDQGCRTRWLRVSHAFHSPHMEPMLEEFAQISRGREYHAPELPIISTLIGELDGGRVMGTPEYWVRQVREPVRFAEGVQALVGQGVGTIVELGPDGALSTLVEECVAESGRVAGIPLMRKDRDEARTVLAALAQIHTRGGEVDWRSFFAGTGAKQVDLPTYAFQRQRYWLASTGRAGDVTAAGLAEADHPLLGAVVALADGEGVVLTGRLTAGSHPWLSDHRVLGEIVVPGTAIVELVWHVGERLGCGRVEELALEAPLILPDHGAVQVQVLVGPPGESGARSVALYSCPGEAIEPEWKKHATGVLLPPVAAENHELTAWPPENATEIDADGVYAFLEGHGFAYGPAFRCLRGAWRRGGEVFAEVALPDDMQAGVDRFGVHPALLDAVLHAAAAETSVVQSEARVPFSWRGVELRATESAVVRARLSLTSDDELSLVAVDPAGRFVATVDSLVTRPISRQQVRSGAIGDCLFEVEWHRKALLGTTAGDDLAIVGDGPSWPESVRATARFATLDEFRAAVDSDVPAPGSVLVAAMSAEEVEGGSLPSRAQESTSDLLALVQSWLADERFAESQLVVVTRAAVSADSDSDVADLVGASSWGLLSSAQSENPGRFVLVDVDGTPESWQALPAAVRAGEPQLALRRGVALVPRLARLTVREEGSSPQLDTDGTVLITGGTGALGGVVARHLVEEHGIRRLVLAGRRGWNAPGVHELVDELARAGAVVEVVACDVADRTDLEHVLAAIPVDWPLRGIVHTAGVLADGVIGSLSAADVGTVFAPKVTGAWHLHELTRDLDLSFFVLFSSFSGIAGAAGQANYAAANTFLDALARYRRARGLPGLSLAWGLWAQPSGMTSGLDAASVERLARTGIAELSTEDGLRLFDAAFAKDRACVVAARLDRALLVGNGRSHAIPALLSALVPVRGGVARKTANSQAADEDALLGLVREHVSAVLGYSGAVEVGGDRAFRDLGFDSLSGVELRNRLAGVLGVRLPATAVFDYPTPRALARFLHQELAGEVASTSTPVTRAASAEEDLVAIVGMGCRFPGGVSSPEELWRLVAGGVDAVAGFPDDRGWDLAALYDPDPDRLGTSYVCEGGFLRDAAEFDADMFGISPREALAMDPQQRLLLEVAWETLERAGIDPFSLHGSRTGVFAGLMYHDYGARFITRAPEGFEGHLGTGNAGSVLSGRVAYSFGFEGPAVTVDTACSSSLVALHLAGQALRAGECEFALAGGVTVMSTPTTFVEFSRQRGLAPDGRCKSFAAAADGTGWGEGAGLVLLERLSDARRNGHEVLAVVRGSAVNQDGASNGLTAPNGPSQQRVITQALTSAGLSVSDVDAVEAHGTGTRLGDPIEAQALIATYGRDRDPGRPLWLGSVKSNIGHTQAAAGVAGVIKMVMAMRQGELPRTLHVDEPSAQVDWSAGTVQLLTENTPWPDSGRLRRAGVSSFGISGTNAHLILEQPPRESQRSTEPDSGSVRDFPVVPWMVSGKTPEALSAQADALMSYLSNRVDASPRDIGYSLAVTRPALDHRAVVLGADRAALLPGLKALAVSNDAAEVITGTRAAGPVGFVFSGQGGQWPGMGSGLHSAFPVFADAFDEACCELDAHLGQMARLRDVLSGSDTQLLDQTLWAQPGLFALQVGLWELLGSWGVRPAVVLGHSVGELAAAFAAGVLSLRDAARLVAGRARLMQALPTGGAMLAAAAGEEQLRPLLADCGDRVGIAAVNAPGSVVLSGDRDVLDDIAGRLDGQGIRSRWLRVSHAFHSHRMDPMLAEFTEIARSVDYRSSGLPIVSTLTGELDEVGMPATPEYWVRQVREPVRFADGVAALAAHGVSTVVEVGPDGVLSALVQECAAGSDQGGRVAAVPLMRSNRDEAHTVTTALAQIHVRGAEVDWRSFFAGTGAKQVELPTYAFQRQRYWLDSPSEPVGQSADPARQSGFWELVEQEDVSALSAALHITGDHDVQASLESVVPVLSSWHRRIRNESLVHQWRYRISWHERADLPDPSLSGTWLVVVPEGWSASRQVLRFNEMFEERGCPAVLFELAGHDEEALAQRFRSLPVASGGISGVLSLLALDESPSSPNAALPNGALNSLVLLRALRAADVSAPLWLATCGGVAVGDVPVNPGQALVWGLGRVVGLEHPAWWGGLVDVPCLLDEDARERLSVVLAGLGEDEIAVRPGGVFVRRLERAGAASGAGSVWRPRGTVLVTGGTGGLGAHVARWLAGAGAEHVVLTSRRGAAAPGAGDLRAELEALGARVSITACDVADRDALAEVLATIPDDCPLTAVMHAAGVVEVGDVASMCLTDFVGVLSAKAGGAANLDELLADVELDAFVLFSSVSGVWGAGGQGAYAAANAYLDALAQQRRARGLVGTAVAWGPWAGDGMAAGEGGAQLRRAGLVPMAADRALLALQGALDRDETSLVVADMAWERFAPVFAMSRRRPLLDELPEAQQALADAENTTDAADSAVPLPRLAGMAAAERRRAMLDLVLAEASIVLGHNGSDPVGPDRAFQELGFDSLMAVELRNRLGEATGLSLPATLIFDYPSPSALAEQLVGELVGAQPATTVVAGADPVDDPVVVVAMGCRYPGDVCSPEELWQLVSAGRDAVSTFPVDRGWDCNTLFDPDPDRAGSTYVREGAFLTGADRFDAGFFGISPREARAMDPQQRLLLEVAWEVFERAGIAPLSLRGSRTGVFAGTNGQDHGAKVAAAPEAAGHLLTGNAASVLAGRLSYTFGLEGPAVAVDTACSSSLVALHLACQSLRSGECDMALAGGVTVMSTPLAFLEFSRQRGLAPDGRCKSFAAAADGTGWGEGAGLVLLERLSDARRNGHRVLAVVRGSAVNQDGASNGLTAPNGPSQQRVIRQALANAGLSASDVDVVEAHGTGTGLGDPIEAQALIATYGQERDPERALWLGSIKSNIGHTQAAAGVAGVIKMVQAMRHGELPATLHVDKPTPQVDWSAGAVRLLTGNTPWPESGRPRRAGVSSFGISGTNAHLILEQPPSEPAEIDQSDRRVTAHPAVIPWMLSARSLAALQAQAAALQARLDRGPGASPLDLGYSLATTRSVLDERAVVWGADREALLSRLAALADGRTAPGVITGSANSGGRIGFVFSGQGSQWLGMGKALCAAFPAFADAFEEACDALSAHLGADVRGVLFGADEQMLDRTLWAQSGIFAVQVGLLGLLRSWGVRPAAVLGHSVGELAAAHAAGVLSLPDAARLVAARAHLMQALPTGGAMLAVATSEAAVGPLLSGVCDRVSIAAINGPESVVLSGDRDVLVELAGEFDARGLRTKWLRVSHAFHSHRMEPILDEYAETARCVEFGEPVVPIVSAATGALDTTGLMCAADYWTRQVRDPVRFGDGVRALVGQGVDTIVEFGPDGALSALVEQCLAGSDQAGRVAAIPLMRRDRDEVETAVAALAHVHVRGGAVDWSACFAGTGARTVELPTYAFQRQRYWLAGQADGRGGDVVADPVDARFWELVERADPEPLVDELCIDRDQPFREVLPVLASWREKQRQEALADSWRYQVRWRSVEVPSAAALRGVWLVVLPADVPRDQPAVVIDALIARGAEVAVLELTEQDLQRSALVDKVRAVIADRTEVTGVLSLLAMDGMPCAAHPHLSRGVAATVILTQVLGDAGVSAPLWLATTGGVEAGTEDGPADPDHGLIWGLGRVVGLEHPQWWGGLIDLPETLDETSRNGLVAALAGTAAEDQLAVRSSGLFVRRVVRAARNPRSETWRSRGTVLITGGTGALGAEVARWLARRGAEHLVLISRRGPEAPGAADLGAELTELGVKVTVLACDVTDRDELAAVLAAVPTEYPLSAVVHTAGVGTPANLAETTLAQFADVLSAKVVGAANLDRLLGGQPLDAFVLFSSISGVWGAGGQGAYSAANAYLDALAERRRACGRPATCIAWGPWAGAGMAVQEGNEAHLRRRGLVPMEPQSALFALQQALSQRETAITVADVDWERFAASFTAARPRPLLEEIVDLRPDTETEEKHGAGELGQQLAALPPAERGHLLLEVVLAETASTLGHDSAEAVQPDRTFAELGFDSLTAVELRNRLNAVTGLRLPPTLVFDHPTPLALSEQLVPALVAEPDNGIESLLAELDRLDTTLAQGPSIPLEDQAKVAERLHALLAKWDGARDGTARATSPQSLTAATDDEIFDLIDRKFRR

SEQ ID NO: 49 - DNA, 16767 bp, Saccharopolyspora spinosa
  CDS (1)..(16764): ORF22; polyketide synthase
atggccaatgaagaaaagctccgcgagtacctcaagcgtgtcgtcgtcgaactggaagaggcgcacgaacgcctgcacgagttggagcgccaggagcacgaccccatcgcgatcgtgtcgatgggatgtcgttatcccggtggcgtctccactccggaggagctgtggcgactggtcgtcgacggaggagacgcgatcgcgaacttccccgaagaccgtggctggaatctggacgagctgttcgatcctgatccgggccgagccgggacctcctacgtccgcgagggtggtttcctgcgcggggtcgcggacttcgatgccgggctcttcgggatcagtccgcgcgaggcacaggcgatggacccgcaacagcggttgctgctggagatctcgtgggaggtgttcgagcgcgccggcattgacccgttttctttgcggggtaccaagaccggtgtgttcgcgggcctgatctaccacgactacgcgtcgcggtttcgcaagacccccgcggagttcgagggttacttcgccaccggcaacgcgggcagcgtcgcatccggccgggtggcttacaccttcgggttagagggcccggcggtcaccgtggacaccgcctgctcgtcgtccctggtggcgctgcacctggcctgccagtccctgcggctgggcgaatgcgacctggccctggccggtggcatttcggtgatggccacgccgggagccttcgtcgagttcagccggcaacgcgcactcgcctcggatggccggtgcaagcccttcgcggatgccgccgacggcaccggctggggcgagggcgccggaatgctgctgctggaacggctgtcggacgcacgacgaaacggccacccggtgctggcggcggtggtcggttccgcgatcaaccaggacgggacgtccaacggcctgaccgcgcccagcggtcccgcacagcagcgagtgatccgccaagccctggcgaacgccgggttgtcgcccgccgaggtcgatgtggtcgaggcgcacggcacgggcacggccttgggcgacccgatcgaggcgcaggccctgatcgccacctacggggcgaaccggtcggcggatcatccgctgctgctgggttccctcaagtcgaacatcggccacacccaggctgccgccggtgtggccggggtgatcaagtcggtcctggccatcaggcaccgggagatgccccgcagcctgcacatcgaccagccatcgcagcacgtggactggtcggcgggcgcggtgcggctgctcacggacagcgttgactggccggatctcggcaggccgcgccgagcaggggtgtcctcgttcggcatgagcggtaccaacgcacacctgatcgtcgaggaagtatccgacgagccggtctcgggcagtaccgagccgaccggggcatttccctggccgctgtccggcaagacggagacggcattgcgcgagcaggctgccgagttgctctccgtagtgaccgagcacccggagccgggactgggggacgtcgggtactcgctggccaccggtcgcgctgcgatggagcaccgggctgtcgtggttgccgacgatcgggactctttcgtcgccggactgacggcgttggctgcgggcgttccggcagccaacgtggtgcagggcgcggccgactgcaagggaaaggtcgcgttcgtgttccccggccagggctcgcattggcaggggatggcgagggaactgtccgaatcctcgccggtgttccggcggaagctggcggaatgcgcggcggctacggccccttacgtggactggtcgctgctcggcgtccttcgcggtgatcccgatgcacccgcgctggatcgcgacgacgtgattcagctcgcgctgttcgccatgatggtgtcgctggccgaactgtggcgttcgtgcggagtggagcccgccgcggtggtcggtcattcccagggcgagatcgccgccgcccatgtggcaggcgctttgtccttgactgatgcggtgcgcatcatcgctgcccgctgcgatgcggtgtcggcgctgaccgggaagggaggcatgctcgcgattgccttgccggaaagcgcggtggtgaagcgaatcgcaggcctgccggagctgaccgttgcggcggtcaacggacccggctccactgtcgtttccggcgaaccgtcggctctggagcgtctgcagaccgaactgaccgcggaaaacgtgcagacccggcgggtgggaattgattacgcctcgcattcgccgcagatcgcgcaggtccagggccggcttctggaccggctgggcgaagtcgggtccgaacctgctgagatcgctttctactcgacggtcaccggcgagcggacggacaccggccgactcgacgccgactactggtaccagaaccttcggcagcccgtccgcttccagcagaccgtcgcccggatggcagatcagggctatcggttcttcgtcgaggtgagcccgcacccgctgctcaccgccggaatccaggaaacgctggaagccgcggacgcgggcggggtggtggtcggttcgctgcggcgtggcgagggcggctcccggcgctggctgacttcgctggccgagtgccaggtgcgcggactgccggtgaattgggaacaggtattcctcaacaccggagcccgacgcgtgccgctgccgacctacccgttccagcggcagcggtactggttggagtccgccgagtacgacgcgggcgatctcggttcggtgggcttgctctccgccgagcatcccctgctcggggctgcggtgacgctggccgatgcgggcgggttcctgctgaccggcaagctgtcggtcaagacccagccctggttggccgaccacgtggtcggcggggcgatcctgctgcccggcaccgcgttcgtggaaatgctgatacgcgccgcggaccaggtcgggtgcgatctgatcgaggagttgtccctgacgactccgctggttttgcccgcgaccggtgcggtgcaggtgcagatcgcggttggcggtccggacgaggccgggcgccgctcggtccgcgtgcattcctgtcgagacgacgccgtgccgcaggactcgtggacctgccacgcgaccggcacgttgacctccagcgatcaccaggacgccggccagggccccgatgggatttggccgcccaacgatgctgtcgcggttccgctggacagcttctacgcccgcgcagctgagcggggcttcgatttcggcccggcgttccaggggttgcaggcggcttggaagcgcggagacgagatcttcgccgaggtcggcctgcccaccgcacaccgcgaagacgccggcaggttcggaatccaccctgctctgctggatgcggcactgcaggcgctgggcgcagccgaagaggatccggacgagggatggctcccgttcgcgtggcaaggtgtgtccctcaaagcgacgggcgcactttcccttcgggtgcacctcgttccggcgggcgcgaatgcggtgtcggtgttcacgaccgacacgactggccaagccgtgctctccatcgattcgctggtgctgcgccagatttcggacaagcagttggcagcggcccgtgcgatggaacacgagtccctgttccgggtcgactggaagcgaatctcgcccggcgctgccaagccggtctcctgggcagtgatcggcaatgacgaactcgcccgagcctgcggctcggcacttggcacggaactccaccccgacctgaccgggttggctgacccgcccccggacgtcgtggtggtgccatgcggtgcgtctcgccaggacttggacgttgcttccgaggcacgtgccgcgacacaacgcatgcttgacctgatccaggattggttggcggcggcgcgattcgccggatctcgcctggtggttgtgacgtgtggtgcggcgtcgacaggtcccgccgagggtgtttccgacctggtgcatgctgcgtcgtggggtttgttgcgttcggcgcagtcggagaacccggaccgattcgtgttggtcgatgtggacggaaccgccgaatcatggcgtgcgctcgcggcggccgtgcgttccggagaaccgcagctggcgttgcgcgccggtgaagtccgggtgcctcgcctggcgcgatgtgttgccgccgaggacagccggatcccagtgcccggtgcggatgggacggtgttgatttccggcggtacgggcctgctgggcgggttggttgcccggcatttggtggcggagcgcggtgtccgccgcctggtgctcgcggggcgacgcggctggagcgcccccggggtcaccgacctggtggatgagttggtgggcctgggagctgcggtcgaggtggcgagctgcgatgtcggggatcgggcccagttggaccggctgctgacgacgatctcggcagagttcccgctgcgcggagtggtgcatgcggccggggcacttgccgacggggtcgtcgagtcgctgacaccagagcacgtggcaaaggtgttcggcccgaaggccgccggtgcgtggcacctgcacgagttgactcttgatctggatctctcgttcttcgtgctcttctcctcgttctccggcgtggcgggggctgcgggtcagggaaactacgcggcggcgaacgcgttcctggacggcctggctcagcaccggcggacggcggggctgcctgcggtgtcgctggcttggggcttgtgggagcagcccagcgggatgaccggagcgctcgatgcggcgggccgtagccgcattgcgcgcaccaatccgccgatgtccgcgccggacgggttgcggctgttcgagatggcgtttcgcgttccgggcgaatcgcttctggttccggtccacgtcgacctgaacgccctgcgcgctgatgcggccgacggcggtgtgcctgcgttgttgcgcgacctggtgccagcgcccgtgcggcggagcgcggtcaacgagtcggcggacgtcaacggtctggttggtcggctgcggaggctgccggacctggatcaggaaacccagctgttgggtttggtgcgcgagcatgtttcggcggtgctggggcattcgggtgcggtcgaggtcggggccgatcgtgctttccgggatttgggttttgattcgttgtccggtgtggagtttcggaaccggcttggcggggtgctgggcgttcggttgccggctactgcggtgttcgactatccgacaccgcgggcgttggttcggttcttgctcgacaaactgattggtggcgtggaggctccgactcccgcaccggcggctgtggcggcggtgactgctgacgatcccgttgtgatcgtggggatgggctgtcgttatccgggtggggtgtcctcgccggaggagctttggcgtttggtggccgggggcttggatgcggtggcggagttcccggacgatcgtggctgggatcaggcggggttgttcgatccggatcccgatcgtcttgggacctcgtatgtgtgtgagggtggcttcctgcgagatgcggcagagttcgatgccggtttcttcgggatttccccgcgtgaggcgttggcgatggatccgcagcagcggttgctgctggaagtcgcttgggaaaccgtggagcgggcggggattgatccgctttcgttgcgggggagccggaccggcgtgttcgcggggctgatgcaccacgactacggcgcgcggttcatcacgagggcgccggagggtttcgagggttatctaggtaatggcagcgcgggaggcgtgttttcgggtcgggttgcgtattcgtttggtttcgagggtcctgcggtgacggtggatacggcgtgttcgtcgtcgttggtggcgctgcacctggcgggtcaagcactgcggtctggtgagtgtgatctggctcttgcgggtggtgtgacggtgatggccacgccggggatgttcgtggagttttcgcgtcaacggggcttggcggcggatgggcggtgcaagtcgtttgcggcggctgcggatggcaccggttggggagaaggcgcgggcttggtgttgttggagcggctgtcggatgcccggcgcaacgggcacgcggttctggcggtcgtgcggggtagcgcggtgaatcaggatggtgcgtcgaatggtttgacggcgccgaatgggccctcgcagcagcgggtgatcacgcaggcgttggcgagtgctggtttgtcggtgtctgatgtggacgccgtggaggcgcatgggactggaaccaggcttggtgatccgattgaggcgcaggctctgattgccacttacgggcaggggcgggatagcgatcggccgttgtggttggggtcggtgaagtcgaatattggtcatacgcaggcggcggcgggtgtcgctggtgtgatcaagatggtgatggcgatgcggcacgggcagctgcccgcgacgttgcatgtggatgaacctacgtcggaagtggattggtcggcgggggatgtccagctcctcacggagaacaccccctggcccggcaacagccatcctcggcgggtgggcgtgtcgtcgttcgggatcagcggcaccaacgcacacgtcatcctcgaacaagcctcgaaaacaccagacgagactgcggacaagagcggtcccgattcggaatcgaccgtggaccttccagcggtcccgttgatcgtgtcggggagaacaccggcagcgctcagcgctcaggcgagcgcattgttgtcctatttgggtgagcgtggcgatatttccacgctggatgcggcgttttcgttggcttcctcccgggccgcgttggaggagcgggcggtggtgctgggagcggaccgcgaaacgttgttgtccgggttggaagcgctggcttccggtcgcgaggcttctggggtggtgtcgggatccccggtctctggcggggttgggttcgtgttcgccggtcagggcggacagtggttggggatgggccgggggctctactcggtttttccggtgttcgctgacgcgtttgacgaagcatgtgccggactggacgcgcatctggggcaggacgtgggggtccgggatgtggtgtttggttccgacgggtccttgttggatcggacgctgtgggcccagtcgggtttgttcgcgttgcaggttggtttgctgagcctgctgggttcgtggggtgtccggccgggtgtggtgctgggccattcggtcggcgagttcgcggcggcggttgcggcgggagtgttgtcgttgccggatgcggctcggatggtggcgggtcgtgcccggttgatgcaggcgttgccttctggcggtgccatgttggcggtggctgctggtgaggagcagctgcggccgttgttggccgatcgggttgatggtgcgggtatcgccgcggtcaacgctcctgagtcggtggtgctctccggcgatcgggaggtgcttgacgacatcgccggcgcgctggatgggcaagggattcggtggcggcggttgcgggtttcgcatgcgtttcattcgtatcggatggacccgatgttgcaggagttcgccgaaatcgcacgcagcgtggactaccggcgtggcgacctaccggtcgtgtcgacgttgacgggtgagctcgacaccgcaggtgtgatggctacgccggagtattgggtgcgtcaggttcgagagcccgtccgcttcgccgacggcgtccgggtgctcgcgcagcaaggggtcgccacgatcttcgaactcggccctgatgcgacgctgtcggccctgattcccgattgtcattcgtgggctgatcaggccatgccgattccgatgctgcgtaaagaccgtacggaaaccgaaactgtggtcgccgcggtggcgcgggcgcacacgcgtggtgttccggtcgaatggtcggcgtatttcgccggcaccggggcacggcgggtcgagttgccgacgtatgccttccagcggcagcggtactggctggaaacatcggattacggcgatgtgacgggtatcggcctggctgcggcggagcatccgttgctgggggccgtggttgcgctggccgatggtgatgggatggtgctgaccggccggttgtcggtggggacgcatccgtggctggcccagcatcgcgtgctgggcgaggtcgtcgtccccggcaccgccatcctggagatggccctgcacgcaggggcgcgtctcggctgtgaccgggtggaagagctcaccctggaaacaccgctggtggtccccgaacgcgcggcgggtgccggtagtcgtggccctgcgggagggaccacagtttcaattgaaactgcggaagaacgtgtgcggacgaacgacgccatcgaaatccagctgctggtgaacgcacccgacgaaggcggtcggcgaagggtgtcgctgtattcccgcccggccggtgggtcgagaggtgggggttggacgcgccacgccaccggcgaactcgtcgtcggcaccaccggtggtagggcggttcctgattggtcggctgagggtgccgagtcgattgctctcgatgagttctacgtcgctctggccggaaacgggttcgagtacgggccgttgttccaggggcttcaggcggcatggcgtcgtggtgacgaggttctcgccgaaatcgccccgccggccgaggccgatgcgatggcgtcgggatacctgctcgacccagcgttgctggatgccgcgctgcaggcgtccgcgctcggcgaccgcccggagcaaggcggcgcgtggctgccgttctcattcaccggcgtcgaactttccgctccggcagggacgatcagcagggtgcggctggagaccaggcgacccgacgcgatatcggtggccgtgatggatgagagtgggcggttgctcgcctcgatcgattctctcaggctacgaagcgtgtcgtcgggacagctggcgaatcgggacgctgtccgcgacgcgctgttcgaggtgacctgggagccggtggcgacgcagtcgacggaaccgggtcgctgggccctgcttggtgatactgcctgcggtaaagacgatctcatcaaactcgcaacggattccgccgaccgctgcgcggatctggcggcgctagccgagaaacttgattccagcgcgctggttcctgatgtcgtggtctactgcgccggagaacaggcggatcccggcaccggcgcagccgcacttgcggagacccagcagacgttggctctgctccaagcgtggttggctgagccgcggttggccgaggcacgtctggtggtggtgacgtgtgcagcggtgacgacggctccgagtgacggtgcatcagagctggcacatgcgccgttgtgggggttgttgcgtgccgcgcaggtggagaacccggggcagtttgtgctggcggacgtcgacggaaccgccgaatcgtggcgtgcgttgccgagtgcgttgggctcgatggaaccgcagttggccctgcggaagggcgcggtgcgagcgccccgcttggcttcggtcgccgggcagatcgacgtgcccgcggttgtggcggatcccgaccgaaccgtgctgatttcgggcggcacgggcctgttggggggcgcggttgcccgccacctggtgaccgaacgcggtgtccgccgattggtgttgacgggccgtcgtggctgggatgctcctggaatcaccgagttggtgggtgagctgaacggcctcggtgccgtggtcgacgtggtggcgtgcgacgtcgcggatcgtgctgatctggagtcgttgctggcggcggtcccggcggaatttccgttgtgcggcgtggtgcatgccgcgggggcgctggccgacggggtgatcgagtcgttgtcaccggacgacgtgggagcggtgttcggcccgaaggcggcgggggcgtggaatctgcacgagctgactcgtgatacggacctgtcgttcttcgcgttgttctcctcgctttccggtgttgccggcgctcctggtcagggcaattatgcggcggcgaacgcgttcctggacgcattggcgcattaccggcggtcacagggactgcctgcggtgtcgctggcctggggcctgtgggagcagccgagcgggatgacggagacgctcagcgaggtcgaccggagcaggatcgcgcgcgccaacccgccgttgtccaccaaggagggattgcggctgttcgatgccgggctggcgctggaccgggcagcggtagttccggcgaagttggacaggactttcctggccgagcaggcgcggtcgggctcgctgcccgcattgttgacggcactggtaccccccatccgtcgtaataggcgggctagcggaaccgagctcgcggacgagggcaccctgctcggggtggtgcgggagcatgccgcggccgtgctggggtattcgagcgcggctgacgtcggggtcgagcgcgctttccgggatctgggttttgattcgttgtctggtgtggagttgcggaaccgccttgccggggtgctgggggtgcggttgccggcgactgcggtgttcgactatccgacgccgagggcgctggcccggttcctgcaccaggaactggcagacgagatcgctacgacgccagcgccggtgacgacgaccagggcaccggtcgccgaagacgatctcgtcgcgatagtcgggatgggatgccgttttcccggtcaggtgtcctcgccggaggagctctggcgtttggtggccgggggcgtggatgcggtcgcggacttcccagccgatcgcggctgggatctggcaggcttgttcgatccggacccggaacgggctgggaagacctacgtgcgggaaggggccttcctcaccgacgccgatcggttcgatgcgggtttcttcgggatttccccgcgtgaggcgttggcgatggatccgcagcaacggctgttgctggagctgtcctgggaggccattgaacgggcagggatcgatccgggttcgctgagggggagtcggaccggtgtgttcgcggggctgatgtaccacgactatggcgcccggttcgccagccgagccccggaaggtttcgaggggtatctcggcaatggcagtgctgggagtgtcgcgtcgggccggattgcgtactcgtttggtttcgagggtcctgcggtgacggtggatactgcgtgttcgtcgtcgttggtggcgttgcatttggcgggtcagtcgttgcgttccggcgaatgcgatctcgcccttgccggtggtgtgacggtgatgtcgacgcccgggacgtttgtggaattctcccgtcagcggggcctggcaccggacgggcggtgcaagtcgttcgcggagagcgcggacggtaccggttggggtgagggtgctggtttggtgttgttggagcggttgtcggatgctcggcggaatgggcatcgggtgttggcggtggttcgtgggtcggcggtgaatcaggatggtgcgtcgaatggcttgaccgcgccgaatggtccctcgcagcagcgggtcatccagcaggcgttggcgagtgcgggtctgtcggtgtccgatgtggatgccgtggaggcgcatgggaccgggaccaggttgggtgatccgattgaggcgcaggctctgattgctacgtatgggcgcgatcgtgatcccggtcggccgttgtggttggggtcggtgaagtccaacatcggtcatacgcaggcggcggcgggtgttgccggtgtgatcaagatggtgatggcgatgcggcacgggcaacttccgcgcacgctgcacgtggatgcaccctcctcgcaggtggattggtcggcggggagggtccagctcctgacggagaacacgccctggcccgacagtggtcgcccctgtcgggtgggggtgtcgtcgttcgggatcagcggcaccaacgcgcacgtcatcctggaacagtccacggggcagatggatcaggcagcggagccggattcgagtcctgttctggatgttccggtggtgccgtgggtggtgtcgggcaaaacacccgaagcgctatccgcccaggcggcaacgttggcgacctatttggaccaaaatgttgatgtctcccctctggacgttgggatttcgcttgcggtgacccgttcggcgctggatgagcgggcggtggtgctggggtcggatcgtgacacgttgttgtctggcctgaatgcgctggctgccggtcatgaggctgctggcgtggttacgggacctgtcgggattggtggccggaccgggtttgtgttcgccggtcaaggcggtcagtggttggggatgggccgccggttgtactcggagtttccggcgttcgccggtgctttcgacgaagcatgcgccgagctcgatgcgaacctggggagggaagtcggggttcgggatgtggtgttcggctccgacgagtccttgctggatcggactttgtgggcgcagtcgggtttgttcgcgttgcaggtcggtctctgggaattgttgggtacgtggggtgttcggcccagcgtagtgctggggcattcggtcggggagctagccgcggcgttcgccgcaggtgtgctgtcgatggcggaggcggctcggctggtggcgggtcgtgcgcggttgatgcaggcgttgccttctggcggtgccatgctggcggtgtccgcgaccgaggcccgagtcggcccgctgctcgatggggtgcgggatcgtgttggtgtcgcagcggttaacgctccggggtcggtggtgctttccggtgaccgggatgtgctcgatggcattgccggtcggctggacgggcaaggtatccggtcgaggtggttgcgggtttcgcacgcgtttcattcgcatcggatggatccgatgctggcggagttcgccgagctcgcacggagcgtggactaccggtctccacggctgccgattgtctcgacgctgaccggaaacctcgatgacgtgggcgtgatggctacgccggagtattgggtgcgccaggtgcgagagcccgtccgcttcgccgacggtgtccaggcgcttgtggaccaaggcgtcgacacgattgtggaactcggtccggacggggcgttgtcgagcttggttcaagagtgtgtggcggagtccgggcgggcgacggggattccgttggtgcggagagaccgtgatgaggtccgaacggtgctggacgctttggcgcagacccacactcgtggtggcgcggtggactgggggtcatttttcgctggtacgagggcaacgcaagtcgaccttcccacgtatgccttccaacgacagcggtactggctggagccatcggattccggtgatgtgaccggtgttggcctgaccggggcggagcatccgctgttgggtgccgtggtgccggtcgcgggcggcgatgaggtgctgctgaccggcaggctgtcggtggggacgcatccgtggctggcggaacaccgcgtgctgggcgaagtcgtcgtccccggcaccgcgttgctggagatggcgtggcgggccggtagccaggtcggttgtgaacgtgtggaggagctcaccttggaggcaccgctggtcctgccggagcggggcgctgcggcggtgcagttggcggtgggggctccggatgaggccggccggcgcagtttgcagctctattcccgaggcgctgatgaagacggcgactggcggcggattgcctccgggctgttggcccaggccaatgcggtgccgccggcggattcgacggcatggccgccggacggcgccgggcaggtcgatctggcggagttctacgagcgcctcgccgagcgcggcttgacctacggtccggtattccaagggctccgcgccgcatggcggcacggcgacgatatcttcgccgaattggccgggtcaccagacgcctcgggtttcggcatccacccggcgctgctggacgctgcactgcacgcgatggcgcttggtgcttcgcccgactcggaagcgcgtctgccgttttcctggcgtggcgcccagctgtaccgcgctgaaggagcagcgcttcgggtacggctctcgccgctgggctccggtgcagtctcattgacgttggtggatgccacagggcgacgagtcgctgcggtggaatcgctttcgacgcgaccggtctccaccgaccagatcggtgccggtcgcggcgatcaagagcggctgctgcacgtcgagtgggtaaggtcggctgaatctgcggggatgtctctgacctcctgcgcggtggtcggtttgggcgaaccggagtggcacgctgcgctgaagaccactggtgtccaagtcgagtcccatgcggaccttgcttcgttggccaccgaggttgccaagcggggttcagctcctggtgcggtcatcgtcccgtgcccgcgaccccgagcgatgcaggagctgccgaccgccgcgcgaagggcgacgcaacaggcgatggcgatgctgcagcaatggcttgccgatgaccggttcgtcagtacgcgcctgatcctgctgacgcatcgggcggtctccgcagttgctggagaagacgtgctcgacctggtacacgcgccgctgtggggcttggtccgcagcgcgcaagcggagcacccggaccgattcgccttgatcgatatggacgacgagcgagcatcgcagacggcactcgccgaagcgctgactgcgggagaagcgcagctcgcggtgcggtcgggagttgtgctggcgccccgcctcggccaggtgaaggtgagtggaggtgaagcgttcaggtgggatgaaggcaccgtgctggtcaccggcggaaccggcgggctcggggccctgctcgcacgccatctggtcagcgcccacggtgtgcggcacctgttgctcgcaagtcgccgtggtctggcggcgcccggagcggatgagctggtggccgagctggagcaggccggcgccgacgtcgcggtcgtcgcgtgcgactcggcagatcgggactcgcttgcgcggctggtggcgtcggtgcctgcggaaaacccgttgcgggtggtggtgcacgccgccggtgtgctggatgacggtgtgctgatgtcgatgtcgccggagcgcttggacgcggtgttgcggcccaaagtggatgccgcgtggtacctgcacgagctgactcgggaactcggtctgtcggcgttcgtgttgttctcctcggtcgcgggcctgttcggcggtgcggggcagagcaattacgctgccggcaacgctttcctggatgccttggcgcattgccggcaggcccaggggctgcccgcgctgtcgctggcctccgggctgtgggcgagtatcgatggaatggcgggcgacctcgctgcggcagatgtggagcggctgtcgcgggcaggcattggcccgctttcggcaccgggagggctggccttgttcgacgctgccgttggctcggacgaaccgttgctggcaccggtgcgactggatgtcgaagcactgcgtgtgcaggcccgatccgtgcagacccggattccggaaatgctgcatggcatggcaatggggccaagccgccgcactccgttcacttccagggttgagccgttgcacgaacggctggccggattgtcggagggcgaacgtcggcagcaagtgctccagcgcgtccgcgccgatatcgcggtggtactggggcacggcaggtcgagcgatgtggacatcgagaagcctttggccgagctgggtttcgactcgctgacggccatcgaactccgcaaccgtctcgctaccgccaccggactgcggcttcccgcgacgctggccttcgaccacggcactgcggcggcactcgcccagcacgtgtgcgcgcagctaggcaccgcgaccgcgccggcaccgaggcgaaccgacgacaacgacgccacggagcccgtgaggtcgctcttccaacaggcgtatgcggctggccggatacttgacgggatggatttggtgaaggtcgctgcccagttgcgaccggtgttcggttcgcctggcgagctggaatccctgccgaaacccgtccagctttcccgtggtcccgaagagcttgccttggtgtgcatgccggcgctgatcgggatgccgcccgcacagcagtacgcgcggatcgccgccgggttccgcgatgtgcgggacgtttcggtgatcccgatgcctggattcattgcgggagaaccgctgccgtccgccatcgaggtggcggttcggacgcaggcggaggcggtgctgcaggaattcgccgggggctcgttcgtactggtcgggcattcctccgggggctggctggcgcacgaggtagccggtgagctggagcgtcgcggggtcgtcccggccggggtcgtactgctggacacctacatccccggtgagatcacgccgaggttctccgtggcgatggcccaccggacgtatgagaagctcgcgactttcacggacatgcaggatgtcggtatcaccgcgatgggcgggtacttccggatgttcaccgagtggactccgacgccgatcggtgctccgacgctgttcgtgcggaccgaagattgcgtcgcagaccctgaagggcggccgtggacagatgactcctggcggccagggtggactctcgcggatgccacggtccaggtgccgggcgaccacttctcgatgatggacgagcacgccgggtccaccgcacaggcagtcgcgagttggcttgacaaactcaaccagcgcaccgctcggcaacgctga

SEQ ID NO: 50 - protein, 5588 aa, Saccharopolyspora spinosa
MANEEKLREYLKRVVVELEEAHERLHELERQEHDPIAIVSMGCRYPGGVSTPEELWRLVVDGGDAIANFPEDRGWNLDELFDPDPGRAGTSYVREGGFLRGVADFDAGLFGISPREAQAMDPQQRLLLEISWEVFERAGIDPFSLRGTKTGVFAGLIYHDYASRFRKTPAEFEGYFATGNAGSVASGRVAYTFGLEGPAVTVDTACSSSLVALHLACQSLRLGECDLALAGGISVMATPGAFVEFSRQRALASDGRCKPFADAADGTGWGEGAGMLLLERLSDARRNGHPVLAAVVGSAINQDGTSNGLTAPSGPAQQRVIRQALANAGLSPAEVDVVEAHGTGTALGDPIEAQALIATYGANRSADHPLLLGSLKSNIGHTQAAAGVAGVIKSVLAIRHREMPRSLHIDQPSQHVDWSAGAVRLLTDSVDWPDLGRPRRAGVSSFGMSGTNAHLIVEEVSDEPVSGSTEPTGAFPWPLSGKTETALREQAAELLSVVTEHPEPGLGDVGYSLATGRAAMEHRAVVVADDRDSFVAGLTALAAGVPAANVVQGAADCKGKVAFVFPGQGSHWQGMARELSESSPVFRRKLAECAAATAPYVDWSLLGVLRGDPDAPALDRDDVIQLALFAMMVSLAELWRSCGVEPAAVVGHSQGEIAAAHVAGALSLTDAVRIIAARCDAVSALTGKGGMLAIALPESAVVKRIAGLPELTVAAVNGPGSTVVSGEPSALERLQTELTAENVQTRRVGIDYASHSPQIAQVQGRLLDRLGEVGSEPAEIAFYSTVTGERTDTGRLDADYWYQNLRQPVRFQQTVARMADQGYRFFVEVSPHPLLTAGIQETLEAADAGGVVVGSLRRGEGGSRRWLTSLAECQVRGLPVNWEQVFLNTGARRVPLPTYPFQRQRYWLESAEYDAGDLGSVGLLSAEHPLLGAAVTLADAGGFLLTGKLSVKTQPWLADHVVGGAILLPGTAFVEMLIRAADQVGCDLIEELSLTTPLVLPATGAVQVQIAVGGPDEAGRRSVRVHSCRDDAVPQDSWTCHATGTLTSSDHQDAGQGPDGIWPPNDAVAVPLDSFYARAAERGFDFGPAFQGLQAAWKRGDEIFAEVGLPTAHREDAGRFGIHPALLDAALQALGAAEEDPDEGWLPFAWQGVSLKATGALSLRVHLVPAGANAVSVFTTDTTGQAVLSIDSLVLRQISDKQLAAARAMEHESLFRVDWKRISPGAAKPVSWAVIGNDELARACGSALGTELHPDLTGLADPPPDVVVVPCGASRQDLDVASEARAATQRMLDLIQDWLAAARFAGSRLVVVTCGAASTGPAEGVSDLVHAASWGLLRSAQSENPDRFVLVDVDGTAESWRALAAAVRSGEPQLALRAGEVRVPRLARCVAAEDSRIPVPGADGTVLISGGTGLLGGLVARHLVAERGVRRLVLAGRRGWSAPGVTDLVDELVGLGAAVEVASCDVGDRAQLDRLLTTISAEFPLRGVVHAAGALADGVVESLTPEHVAKVFGPKAAGAWHLHELTLDLDLSFFVLFSSFSGVAGAAGQGNYAAANAFLDGLAQHRRTAGLPAVSLAWGLWEQPSGMTGALDAAGRSRIARTNPPMSAPDGLRLFEMAFRVPGESLLVPVHVDLNALRADAADGGVPALLRDLVPAPVRRSAVNESADVNGLVGRLRRLPDLDQETQLLGLVREHVSAVLGHSGAVEVGADRAFRDLGFDSLSGVEFRNRLGGVLGVRLPATAVFDYPTPRALVRFLLDKLIGGVEAPTPAPAAVAAVTADDPVVIVGMGCRYPGGVSSPEELWRLVAGGLDAVAEFPDDRGWDQAGLFDPDPDRLGTSYVCEGGFLRDAAEFDAGFFGISPREALAMDPQQRLLLEVAWETVERAGIDPLSLRGSRTGVFAGLMHHDYGARFITRAPEGFEGYLGNGSAGGVFSGRVAYSFGFEGPAVTVDTACSSSLVALHLAGQALRSGECDLALAGGVTVMATPGMFVEFSRQRGLAADGRCKSFAAAADGTGWGEGAGLVLLERLSDARRNGHAVLAVVRGSAVNQDGASNGLTAPNGPSQQRVITQALASAGLSVSDVDAVEAHGTGTRLGDPIEAQALIATYGQGRDSDRPLWLGSVKSNIGHTQAAAGVAGVIKMVMAMRHGQLPATLHVDEPTSEVDWSAGDVQLLTENTPWPGNSHPRRVGVSSFGISGTNAHVILEQASKTPDETADKSGPDSESTVDLPAVPLIVSGRTPAALSAQASALLSYLGERGDISTLDAAFSLASSRAALEERAVVLGADRETLLSGLEALASGREASGVVSGSPVSGGVGFVFAGQGGQWLGMGRGLYSVFPVFADAFDEACAGLDAHLGQDVGVRDVVFGSDGSLLDRTLWAQSGLFALQVGLLSLLGSWGVRPGVVLGHSVGEFAAAVAAGVLSLPDAARMVAGRARLMQALPSGGAMLAVAAGEEQLRPLLADRVDGAGIAAVNAPESVVLSGDREVLDDIAGALDGQGIRWRRLRVSHAFHSYRMDPMLQEFAEIARSVDYRRGDLPVVSTLTGELDTAGVMATPEYWVRQVREPVRFADGVRVLAQQGVATIFELGPDATLSALIPDCHSWADQAMPIPMLRKDRTETETVVAAVARAHTRGVPVEWSAYFAGTGARRVELPTYAFQRQRYWLETSDYGDVTGIGLAAAEHPLLGAVVALADGDGMVLTGRLSVGTHPWLAQHRVLGEVVVPGTAILEMALHAGARLGCDRVEELTLETPLVVPERAAGAGSRGPAGGTTVSIETAEERVRTNDAIEIQLLVNAPDEGGRRRVSLYSRPAGGSRGGGWTRHATGELVVGTTGGRAVPDWSAEGAESIALDEFYVALAGNGFEYGPLFQGLQAAWRRGDEVLAEIAPPAEADAMASGYLLDPALLDAALQASALGDRPEQGGAWLPFSFTGVELSAPAGTISRVRLETRRPDAISVAVMDESGRLLASIDSLRLRSVSSGQLANRDAVRDALFEVTWEPVATQSTEPGRWALLGDTACGKDDLIKLATDSADRCADLAALAEKLDSSALVPDVVVYCAGEQADPGTGAAALAETQQTLALLQAWLAEPRLAEARLVVVTCAAVTTAPSDGASELAHAPLWGLLRAAQVENPGQFVLADVDGTAESWRALPSALGSMEPQLALRKGAVRAPRLASVAGQIDVPAVVADPDRTVLISGGTGLLGGAVARHLVTERGVRRLVLTGRRGWDAPGITELVGELNGLGAVVDVVACDVADRADLESLLAAVPAEFPLCGVVHAAGALADGVIESLSPDDVGAVFGPKAAGAWNLHELTRDTDLSFFALFSSLSGVAGAPGQGNYAAANAFLDALAHYRRSQGLPAVSLAWGLWEQPSGMTETLSEVDRSRIARANPPLSTKEGLRLFDAGLALDRAAVVPAKLDRTFLAEQARSGSLPALLTALVPPIRRNRRASGTELADEGTLLGVVREHAAAVLGYSSAADVGVERAFRDLGFDSLSGVELRNRLAGVLGVRLPATAVFDYPTPRALARFLHQELADEIATTPAPVTTTRAPVAEDDLVAIVGMGCRFPGQVSSPEELWRLVAGGVDAVADFPADRGWDLAGLFDPDPERAGKTYVREGAFLTDADRFDAGFFGISPREALAMDPQQRLLLELSWEAIERAGIDPGSLRGSRTGVFAGLMYHDYGARFASRAPEGFEGYLGNGSAGSVASGRIAYSFGFEGPAVTVDTACSSSLVALHLAGQSLRSGECDLALAGGVTVMSTPGTFVEFSRQRGLAPDGRCKSFAESADGTGWGEGAGLVLLERLSDARRNGHRVLAVVRGSAVNQDGASNGLTAPNGPSQQRVIQQALASAGLSVSDVDAVEAHGTGTRLGDPIEAQALIATYGRDRDPGRPLWLGSVKSNIGHTQAAAGVAGVIKMVMAMRHGQLPRTLHVDAPSSQVDWSAGRVQLLTENTPWPDSGRPCRVGVSSFGISGTNAHVILEQSTGQMDQAAEPDSSPVLDVPVVPWVVSGKTPEALSAQAATLATYLDQNVDVSPLDVGISLAVTRSALDERAVVLGSDRDTLLSGLNALAAGHEAAGVVTGPVGIGGRTGFVFAGQGGQWLGMGRRLYSEFPAFAGAFDEACAELDANLGREVGVRDVVFGSDESLLDRTLWAQSGLFALQVGLWELLGTWGVRPSVVLGHSVGELAAAFAAGVLSMAEAARLVAGRARLMQALPSGGAMLAVSATEARVGPLLDGVRDRVGVAAVNAPGSVVLSGDRDVLDGIAGRLDGQGIRSRWLRVSHAFHSHRMDPMLAEFAELARSVDYRSPRLPIVSTLTGNLDDVGVMATPEYWVRQVREPVRFADGVQALVDQGVDTIVELGPDGALSSLVQECVAESGRATGIPLVRRDRDEVRTVLDALAQTHTRGGAVDWGSFFAGTRATQVDLPTYAFQRQRYWLEPSDSGDVTGVGLTGAEHPLLGAVVPVAGGDEVLLTGRLSVGTHPWLAEHRVLGEVVVPGTALLEMAWRAGSQVGCERVEELTLEAPLVLPERGAAAVQLAVGAPDEAGRRSLQLYSRGADEDGDWRRIASGLLAQANAVPPADSTAWPPDGAGQVDLAEFYERLAERGLTYGPVFQGLRAAWRHGDDIFAELAGSPDASGFGIHPALLDAALHAMALGASPDSEARLPFSWRGAQLYRAEGAALRVRLSPLGSGAVSLTLVDATGRRVAAVESLSTRPVSTDQIGAGRGDQERLLHVEWVRSAESAGMSLTSCAVVGLGEPEWHAALKTTGVQVESHADLASLATEVAKRGSAPGAVIVPCPRPRAMQELPTAARRATQQAMAMLQQWLADDRFVSTRLILLTHRAVSAVAGEDVLDLVHAPLWGLVRSAQAEHPDRFALIDMDDERASQTALAEALTAGEAQLAVRSGVVLAPRLGQVKVSGGEAFRWDEGTVLVTGGTGGLGALLARHLVSAHGVRHLLLASRRGLAAPGADELVAELEQAGADVAVVACDSADRDSLARLVASVPAENPLRVVVHAAGVLDDGVLMSMSPERLDAVLRPKVDAAWYLHELTRELGLSAFVLFSSVAGLFGGAGQSNYAAGNAFLDALAHCRQAQGLPALSLASGLWASIDGMAGDLAAADVERLSRAGIGPLSAPGGLALFDAAVGSDEPLLAPVRLDVEALRVQARSVQTRIPEMLHGMAMGPSRRTPFTSRVEPLHERLAGLSEGERRQQVLQRVRADIAVVLGHGRSSDVDIEKPLAELGFDSLTAIELRNRLATATGLRLPATLAFDHGTAAALAQHVCAQLGTATAPAPRRTDDNDATEPVRSLFQQAYAAGRILDGMDLVKVAAQLRPVFGSPGELESLPKPVQLSRGPEELALVCMPALIGMPPAQQYARIAAGFRDVRDVSVIPMPGFIAGEPLPSAIEVAVRTQAEAVLQEFAGGSFVLVGHSSGGWLAHEVAGELERRGVVPAGVVLLDTYIPGEITPRFSVAMAHRTYEKLATFTDMQDVGITAMGGYFRMFTEWTPTPIGAPTLFVRTEDCVADPEGRPWTDDSWRPGWTLADATVQVPGDHFSMMDEHAGSTAQAVASWLDKLNQRTARQR

SEQ ID NO: 51 - DNA, 2363 bp, Saccharopolyspora spinosa
cccgggccggccgtgggcgccgggtccgcggggcggaacgggtctgccgggctgaccctgcgggccgcctggccacctcggccggtcctccacgaatcctccttggcctgccggcgggcgttacagtttcgggaagtgattttgctcgtgttccgaatgcaggctagcggtgttcctggggcggttgggcaggtcccagcaacagtggtgatatccctcataagggcgaagcgacttcgtcacgttgcgtaatgcgggatcctgcttcgtagctcggtgtgtcatgccagactgcgcacgcggacctgcagcgggccgcgaaatcccggcgaggaagggcgcgatgcggattctggtcaccggcggagccggtttcatcggctcgcactacgttcggcagttgctcggtggtgcgtaccccgcattcgccgacgccgacgtggtcgtgctcgacaagctcacctacgccggcaacgaggcgaacctggcgccggtcgcggacaacccccggctgaagttcgtctgcggcgacatctgcgaccgcgaactggttggcggcctgatgtccggcgtggacgtggtggtgcacttcgccgccgaaacccacgtcgaccgctcgatcaccggctcggacgccttcgtgatcaccaacgtggtcggcaccaacgtgctgctgcaggccgcgctcgacgccgagatcggcaagttcgtgcacgtttccaccgacgaggtctacggctccatcgaggacggctcgtggcccgaagaccacgcgctggagccgaattccccgtactcggcggcgaaagcgggctcggacctgctggcccgcgcctaccaccgcacccacggactgccggtgtgcatcacccgctgctccaacaactacgggccctaccagttcccggagaaggtgctgccgctgttcatcacgaacctgatggacggcagccaggtgccgctctacggcgacgggctcaacgtgcgggactggctgcacgtcagcgaccactgccggggcatccagctggtggccgactccgggcgcgcgggcgagatctacaacatcggcggcggcaccgagctgaccaacaacgagctgaccgagcggctgctggcagagctgggcctcgactggtcggtggtgcggccggtcaccgaccgcaagggccacgaccgccgctactcggtggaccacagcaagatcgtcgaggaactggggtacgcgccgcaggtcgacttcgagaccgggctgcgcgagacaatccgctggtaccaggacaaccgggactggtgggagccgctgaaggcccgatcggcggtggctcgatgagtcgcctcgccgtgctggtgcccggcggccgcggccagctgggctcggagctggcccggatcctccccgcgcggacgggggcgctggtgcaccggccgggttccggggaactggacgtcaccgacgccgaggaggtcgccgacgcgttgggttccttcgcggagacggcgaaggacgcggagctgcgaccggtggtgatcaacgccgcggcgtacacggcggtggacgcggccgagtccgacccggaccgcgcggcccggatcaacgccgaaggcgcggcctcgctggcgaaagcgtgccggagcagcggtctgcccctggtgcacgtgtcgacggattacgtgttccccggtgatggggcccggccgtacgagccgacggacccgaccgggccgcgatcggtctacgggcgcaccaagctcgaaggcgaacgggccgtgctggagtccggcgcgcgggcctgggtggtgcgcacggcatgggtgtacggcgcgagcggcaagaacttcctgaaaacgatgatccgcctctcgggggagcgcgacacgctgtccgttgtggacgatcagatcggctcgccgacttgggcggcggacctggcgagcggcctgctggagctggccgaacgggtcgccgaacgccgtggaccggagcagaaggtgctgcactgcaccaattccggccaggtgacctggtacgagttcgcgcgggcgatcttcgcggaattcggcctggacgagaaccgcgtccacccgtgcacgacggcggacttccccctcccggcgcaccgcccggcctactcggtcctgtccgacgtggcgtggcgagaggcgggcctgaccccgatgcgcacctggcgggaagccctggcggcggccttcgagaaagacggcgaaaccctccgaacccgctgaccagtcacccggagggcgcgagtagccccggcagggccgcttcgacgcgatatcggctggcgcggtgcgcacaatgggtgtcgccggggcgaggaaggaaggccaggtgccccggg

SEQ ID NO: 52 - DNA, 990 bp, Saccharopolyspora spinosa
  CDS (1)..(987): ORF23; dNDP-glucose-4,6-dehydratase
atgcggattctggtcaccggcggagccggtttcatcggctcgcactacgttcggcagttgctcggtggtgcgtaccccgcattcgccgacgccgacgtggtcgtgctcgacaagctcacctacgccggcaacgaggcgaacctggcgccggtcgcggacaacccccggctgaagttcgtctgcggcgacatctgcgaccgcgaactggttggcggcctgatgtccggcgtggacgtggtggtgcacttcgccgccgaaacccacgtcgaccgctcgatcaccggctcggacgccttcgtgatcaccaacgtggtcggcaccaacgtgctgctgcaggccgcgctcgacgccgagatcggcaagttcgtgcacgtttccaccgacgaggtctacggctccatcgaggacggctcgtggcccgaagaccacgcgctggagccgaattccccgtactcggcggcgaaagcgggctcggacctgctggcccgcgcctaccaccgcacccacggactgccggtgtgcatcacccgctgctccaacaactacgggccctaccagttcccggagaaggtgctgccgctgttcatcacgaacctgatggacggcagccaggtgccgctctacggcgacgggctcaacgtgcgggactggctgcacgtcagcgaccactgccggggcatccagctggtggccgactccgggcgcgcgggcgagatctacaacatcggcggcggcaccgagctgaccaacaacgagctgaccgagcggctgctggcagagctgggcctcgactggtcggtggtgcggccggtcaccgaccgcaagggccacgaccgccgctactcggtggaccacagcaagatcgtcgaggaactggggtacgcgccgcaggtcgacttcgagaccgggctgcgcgagacaatccgctggtaccaggacaaccgggactggtgggagccgctgaaggcccgatcggcggtggctcgatga

SEQ ID NO: 53 - protein, 329 aa, Saccharopolyspora spinosa
MRILVTGGAGFIGSHYVRQLLGGAYPAFADADVVVLDKLTYAGNEANLAPVADNPRLKFVCGDICDRELVGGLMSGVDVVVHFAAETHVDRSITGSDAFVITNVVGTNVLLQAALDAEIGKFVHVSTDEVYGSIEDGSWPEDHALEPNSPYSAAKAGSDLLARAYHRTHGLPVCITRCSNNYGPYQFPEKVLPLFITNLMDGSQVPLYGDGLNVRDWLHVSDHCRGIQLVADSGRAGEIYNIGGGTELTNNELTERLLAELGLDWSVVRPVTDRKGHDRRYSVDHSKIVEELGYAPQVDFETGLRETIRWYQDNRDWWEPLKARSAVAR

SEQ ID NO: 54 - DNA, 918 bp, Saccharopolyspora spinosa
  CDS (1)..(915): ORF24; dNDP-4-keto-6-deoxyglucose-3,5-epimerase
atgagtcgcctcgccgtgctggtgcccggcggccgcggccagctgggctcggagctggcccggatcctccccgcgcggacgggggcgctggtgcaccggccgggttccggggaactggacgtcaccgacgccgaggaggtcgccgacgcgttgggttccttcgcggagacggcgaaggacgcggagctgcgaccggtggtgatcaacgccgcggcgtacacggcggtggacgcggccgagtccgacccggaccgcgcggcccggatcaacgccgaaggcgcggcctcgctggcgaaagcgtgccggagcagcggtctgcccctggtgcacgtgtcgacggattacgtgttccccggtgatggggcccggccgtacgagccgacggacccgaccgggccgcgatcggtctacgggcgcaccaagctcgaaggcgaacgggccgtgctggagtccggcgcgcgggcctgggtggtgcgcacggcatgggtgtacggcgcgagcggcaagaacttcctgaaaacgatgatccgcctctcgggggagcgcgacacgctgtccgttgtggacgatcagatcggctcgccgacttgggcggcggacctggcgagcggcctgctggagctggccgaacgggtcgccgaacgccgtggaccggagcagaaggtgctgcactgcaccaattccggccaggtgacctggtacgagttcgcgcgggcgatcttcgcggaattcggcctggacgagaaccgcgtccacccgtgcacgacggcggacttccccctcccggcgcaccgcccggcctactcggtcctgtccgacgtggcgtggcgagaggcgggcctgaccccgatgcgcacctggcgggaagccctggcggcggccttcgagaaagacggcgaaaccctccgaacccgctga

SEQ ID NO: 55 - protein, 305 aa, Saccharopolyspora spinosa
MSRLAVLVPGGRGQLGSELARILPARTGALVHRPGSGELDVTDAEEVADALGSFAETAKDAELRPVVINAAAYTAVDAAESDPDRAARINAEGAASLAKACRSSGLPLVHVSTDYVFPGDGARPYEPTDPTGPRSVYGRTKLEGERAVLESGARAWVVRTAWVYGASGKNFLKTMIRLSGERDTLSVVDDQIGSPTWAADLASGLLELAERVAERRGPEQKVLHCTNSGQVTWYEFARAIFAEFGLDENRVHPCTTADFPLPAHRPAYSVLSDVAWREAGLTPMRTWREALAAAFEKDGETLRTR

The invention claimed is:

1. A vector for heterologous expression of a gene cluster for spinosyn biosynthesis, comprising a DNA fragment larger than 40 kb wherein the DNA fragment comprises a nucleic acid comprising a nucleotide sequence selected from the group consisting of (a) SEQ ID NO: 1, and
(b) a sequence which, due to the degeneracy of the genetic code, codes for the same amino acid sequences as the sequence defined in (a).

2. The vector of claim 1, wherein the vector is comprised of a BAC vector, a PAC vector or a vector functionally equivalent to BAC or PAC vectors.

3. The Vector of claim 2 selected from the BAC clones having the deposition numbers DSM 13010, DSM 13011 and DSM 13012.

4. The vector of claim 1, wherein the vector comprises a shuttle vector which can be transferred to prokaryotes and to eukaryotes.

5. The vector of claim 1, wherein the vector comprises a shuttle vector which can be transferred to Gram-negative bacteria, Gram-positive bacteria and Archea.

6. The vector of claim 1, wherein the vector comprises a shuttle vector which can be transferred to *Escherichia coli* and to actinomycetes.

7. The vector of claim 1, wherein the vector comprises a shuttle vector which can be transferred to *Escherichia coli* and to *Streptomyces*.

8. The vector of claim 1, wherein the vector can be replicated autonomously in a prokaryote.

9. The vector of claim 1, wherein the vector can be integrated into the genome of a prokaryote via the phage ΦC31 integration mechanism, the pSAM2 integration mechanism or the mini-circle integration mechanism.

10. The vector of claim 1, wherein the vector can be integrated into the genome of a prokaryote by RecA-mediated recombination.

11. The vector of claim 1, wherein the vector can be integrated into the genome of a prokaryote by RecE- and RecT-mediated recombination.

12. A host cell comprising the vector of claim 1.

13. The host cell of claim 12, wherein the host cell is a prokaryotic or eukaryotic cell.

14. The host cell of claim 13, wherein the prokaryotic cell belongs to the group of actinomycetes.

15. The host cell of claim 13, wherein the eukaryotic cell is a plant cell.

16. The Vector of claim 1, wherein the DNA fragment is larger than 60 kb.

17. The Vector of claim 1 wherein the nucleic acid is functionally linked to regulatory sequences which ensure expression of the coding regions of the nucleic acid in prokaryotic or eukaryotic cells.

* * * * *